(12) United States Patent
Geall et al.

(10) Patent No.: US 10,487,149 B2
(45) Date of Patent: *Nov. 26, 2019

(54) NUCLEIC ACID-POLYPEPTIDE COMPOSITIONS AND USES THEREOF

(71) Applicant: Avidity Biosciences, Inc., La Jolla, CA (US)

(72) Inventors: Andrew John Geall, Carlsbad, CA (US); Venkata Ramana Doppalapudi, San Diego, CA (US); David Sai-Ho Chu, La Jolla, CA (US); Michael Caramian Cochran, La Jolla, CA (US); Rachel Elizabeth Johns, San Diego, CA (US); Palani Balu, Cupertino, CA (US); Rob Burke, Encinitas, CA (US); Beatrice Diana Darimont, San Diego, CA (US)

(73) Assignee: AVIDITY BIOSCIENCES, INC., La Jolla, CA (US)

( * ) Notice: Subject to any disclaimer, the term of this patent is extended or adjusted under 35 U.S.C. 154(b) by 0 days.

This patent is subject to a terminal disclaimer.

(21) Appl. No.: 16/129,694

(22) Filed: Sep. 12, 2018

(65) Prior Publication Data

US 2019/0000987 A1 Jan. 3, 2019

Related U.S. Application Data

(63) Continuation of application No. 16/128,440, filed on Sep. 11, 2018, which is a continuation of application No. PCT/US2017/025608, filed on Mar. 31, 2017.

(60) Provisional application No. 62/316,919, filed on Apr. 1, 2016.

(51) Int. Cl.
| | |
|---|---|
| *C07K 16/28* | (2006.01) |
| *C12N 15/113* | (2010.01) |
| *A61K 31/713* | (2006.01) |
| *A61K 47/68* | (2017.01) |
| *A61K 47/60* | (2017.01) |
| *A61P 35/00* | (2006.01) |
| *C07K 16/30* | (2006.01) |
| *A61P 35/02* | (2006.01) |
| *A61K 31/7088* | (2006.01) |
| *A61K 48/00* | (2006.01) |
| *A61K 39/00* | (2006.01) |

(52) U.S. Cl.
CPC ...... *C07K 16/2863* (2013.01); *A61K 31/7088* (2013.01); *A61K 31/713* (2013.01); *A61K 47/60* (2017.08); *A61K 47/6807* (2017.08); *A61K 47/6851* (2017.08); *A61K 48/005* (2013.01); *A61K 48/0033* (2013.01); *A61K 48/0075* (2013.01); *A61P 35/00* (2018.01); *A61P 35/02* (2018.01); *C07K 16/30* (2013.01); *C07K 16/3061* (2013.01); *C12N 15/113* (2013.01); *C12N 15/1135* (2013.01); *C12N 15/1138* (2013.01); *A61K 2039/505* (2013.01); *C07K 2317/21* (2013.01); *C07K 2317/24* (2013.01); *C07K 2317/55* (2013.01); *C07K 2317/569* (2013.01); *C07K 2317/622* (2013.01); *C12N 2310/14* (2013.01); *C12N 2310/315* (2013.01); *C12N 2310/321* (2013.01); *C12N 2310/3231* (2013.01); *C12N 2310/3513* (2013.01); *C12N 2320/32* (2013.01)

(58) Field of Classification Search
CPC .............. A61K 47/6807; C12N 15/113; C12N 2310/3231; C12N 2310/321; C12N 2310/315; C12N 2310/332

See application file for complete search history.

(56) References Cited

U.S. PATENT DOCUMENTS

| | | |
|---|---|---|
| 4,694,778 A | 9/1987 | Learn et al. |
| 5,142,047 A | 8/1992 | Summerton et al. |
| 5,185,444 A | 2/1993 | Summerton et al. |
| 5,736,557 A | 4/1998 | Hofheinz et al. |
| 5,889,136 A | 3/1999 | Scaringe et al. |
| 5,898,031 A | 4/1999 | Crooke |
| 6,008,400 A | 12/1999 | Scaringe et al. |
| 6,107,094 A | 8/2000 | Crooke |
| 6,111,086 A | 8/2000 | Scaringe |
| 6,821,783 B1 | 11/2004 | Comely et al. |
| 6,849,272 B1 | 2/2005 | Langer et al. |
| 6,884,869 B2 | 4/2005 | Senter et al. |
| 6,942,972 B2 | 9/2005 | Farooqui et al. |
| 7,056,704 B2 | 6/2006 | Tuschl et al. |

(Continued)

FOREIGN PATENT DOCUMENTS

| | | |
|---|---|---|
| EP | 1144623 B1 | 8/2002 |
| EP | 0928290 B1 | 3/2005 |

(Continued)

OTHER PUBLICATIONS

Goldmacher and Kovtun, Therapeutic Delivery, 2011, vol. 2, pp. 397-416 (Year: 2011).*
Casi et al (Journal of Controlled Release, 2012, vol. 161, pp. 422-428) (Year: 2012).*
Yuan et al (Cancer Discovery, 2014, vol. 4, pp. 1182-1197, Final Publication) (Year: 2014).*
Carter and Senter, The Cancer Journal, 2008, vol. 14, pp. 154-169 (Year: 2008).*

(Continued)

*Primary Examiner* — Karen A. Canella
(74) *Attorney, Agent, or Firm* — Wilson Sonsini Goodrich & Rosati

(57) ABSTRACT

Disclosed herein are compositions and pharmaceutical formulations that comprise a binding moiety conjugated to a polynucleic acid molecule and a polymer. Also described herein include methods for treating a cancer which utilize a composition or a pharmaceutical formulation comprising a binding moiety conjugated to a polynucleic acid molecule and a polymer.

18 Claims, 136 Drawing Sheets

Specification includes a Sequence Listing.

(56) References Cited

U.S. PATENT DOCUMENTS

| | | |
|---|---|---|
| 7,078,196 B2 | 7/2006 | Tuschl et al. |
| 7,132,519 B2 | 11/2006 | Monforte et al. |
| 7,351,855 B2 | 4/2008 | Coutts et al. |
| 7,432,249 B2 | 10/2008 | Crooke |
| 7,432,250 B2 | 10/2008 | Crooke |
| 7,459,547 B2 | 12/2008 | Zamore et al. |
| 7,498,298 B2 | 3/2009 | Doronina et al. |
| 7,521,232 B2 | 4/2009 | Moon |
| 7,595,387 B2 | 9/2009 | Leake et al. |
| 7,629,321 B2 | 12/2009 | Crooke |
| 7,732,593 B2 | 6/2010 | Zamore et al. |
| 7,750,144 B2 | 7/2010 | Zamore et al. |
| 7,772,203 B2 | 8/2010 | Zamore et al. |
| 7,786,290 B2 | 8/2010 | Woppmann et al. |
| 7,829,693 B2 | 11/2010 | Kreutzer et al. |
| 7,834,171 B2 | 11/2010 | Khvorova et al. |
| 7,850,975 B2 | 12/2010 | Mullis |
| 7,928,217 B2 | 4/2011 | Vornlocher et al. |
| 7,943,762 B2 | 5/2011 | Weller et al. |
| 8,137,695 B2 | 3/2012 | Rozema et al. |
| 8,202,979 B2 | 6/2012 | Mcswiggen et al. |
| 8,268,986 B2 | 9/2012 | Beigelman et al. |
| 8,273,866 B2 | 9/2012 | Mcswiggen et al. |
| 8,283,329 B2 | 10/2012 | Fire et al. |
| 8,288,352 B2 | 10/2012 | Doronina et al. |
| 8,304,530 B2 | 11/2012 | Zamore et al. |
| 8,309,704 B2 | 11/2012 | Zamore et al. |
| 8,309,705 B2 | 11/2012 | Zamore et al. |
| 8,329,892 B2 | 12/2012 | Zamore et al. |
| 8,334,373 B2 | 12/2012 | Vornlocher et al. |
| 8,362,231 B2 | 1/2013 | Tuschl et al. |
| 8,372,968 B2 | 2/2013 | Tuschl et al. |
| 8,389,710 B2 | 3/2013 | Bruno et al. |
| 8,420,391 B2 | 4/2013 | Tuschl et al. |
| 8,445,237 B2 | 5/2013 | Tuschl et al. |
| 8,481,698 B2 | 7/2013 | Lieberman et al. |
| 8,546,143 B2 | 10/2013 | Kreutzer et al. |
| 8,552,171 B2 | 10/2013 | Tuschl et al. |
| 8,557,292 B2 | 10/2013 | Davis et al. |
| 8,591,910 B2 | 11/2013 | Mullis |
| 8,604,184 B2 | 12/2013 | Mullis et al. |
| 8,609,105 B2 | 12/2013 | Senter et al. |
| 8,632,997 B2 | 1/2014 | Tuschl et al. |
| 8,648,185 B2 | 2/2014 | Mcswiggen et al. |
| 8,691,786 B2 | 4/2014 | Rossi et al. |
| 8,697,688 B2 | 4/2014 | Howard et al. |
| 8,746,999 B2 | 6/2014 | Davis et al. |
| 8,765,930 B2 | 7/2014 | Tuschl et al. |
| 8,772,469 B2 | 7/2014 | Uhlmann et al. |
| 8,778,902 B2 | 7/2014 | Tuschl et al. |
| 8,790,922 B2 | 7/2014 | Tuschl et al. |
| 8,796,016 B2 | 8/2014 | Tuschl et al. |
| 8,796,443 B2 | 8/2014 | Khvorova et al. |
| 8,846,875 B2 | 9/2014 | Schwartz et al. |
| 8,846,894 B2 | 9/2014 | Mcswiggen et al. |
| 8,853,384 B2 | 10/2014 | Tuschl et al. |
| 8,895,718 B2 | 11/2014 | Tuschl et al. |
| 8,895,721 B2 | 11/2014 | Tuschl et al. |
| 8,906,847 B2 | 12/2014 | Cleemann et al. |
| 8,933,044 B2 | 1/2015 | Tuschl et al. |
| 8,936,910 B2 | 1/2015 | Mitsch et al. |
| 8,993,745 B2 | 3/2015 | Tuschl et al. |
| 9,012,138 B2 | 4/2015 | Tuschl et al. |
| 9,012,621 B2 | 4/2015 | Tuschl et al. |
| 9,089,614 B2 | 7/2015 | Lin et al. |
| 9,096,636 B2 | 8/2015 | Baker et al. |
| 9,175,289 B2 | 11/2015 | Khvorova et al. |
| 9,193,753 B2 | 11/2015 | Tuschl et al. |
| 9,212,364 B2 | 12/2015 | Sah et al. |
| 9,284,551 B2 | 3/2016 | Puri et al. |
| 9,328,345 B2 | 5/2016 | Li et al. |
| 9,364,553 B2 | 6/2016 | Lee |
| 9,481,905 B2 | 11/2016 | Chen et al. |
| 2002/0142980 A1 | 10/2002 | Thompson et al. |
| 2011/0039914 A1 | 2/2011 | Pavco et al. |
| 2011/0263680 A1 | 10/2011 | Khvorova et al. |
| 2011/0263686 A1 | 10/2011 | Wilton et al. |
| 2011/0301218 A1 | 12/2011 | Bozzoni et al. |
| 2012/0065169 A1 | 3/2012 | Hanson et al. |
| 2012/0122800 A1 | 5/2012 | Kadushin et al. |
| 2012/0270925 A1 | 10/2012 | Wilton et al. |
| 2013/0028919 A1 | 1/2013 | Howard et al. |
| 2013/0045520 A1 | 2/2013 | Woolf et al. |
| 2013/0052731 A1 | 2/2013 | Ma et al. |
| 2013/0164366 A1 | 6/2013 | Kreutzer et al. |
| 2013/0172238 A1 | 7/2013 | Mitsch et al. |
| 2013/0177579 A1* | 7/2013 | Lin .................. C07K 16/28 424/174.1 |
| 2013/0177631 A1 | 7/2013 | Kreutzer et al. |
| 2013/0309256 A1 | 11/2013 | Lyon et al. |
| 2014/0127239 A1 | 5/2014 | Howard |
| 2014/0194610 A1 | 7/2014 | Verdine et al. |
| 2014/0286970 A1 | 9/2014 | Jeffrey et al. |
| 2014/0288158 A1 | 9/2014 | Rajeev et al. |
| 2014/0294851 A1 | 10/2014 | Nguyen |
| 2014/0296321 A1 | 10/2014 | Iversen |
| 2014/0357700 A1 | 12/2014 | Rossi et al. |
| 2015/0018540 A1 | 1/2015 | Prakash et al. |
| 2015/0037360 A1 | 2/2015 | Smith |
| 2015/0038554 A1 | 2/2015 | Brown |
| 2015/0038555 A1 | 2/2015 | Brown |
| 2015/0056220 A1 | 2/2015 | Chennamsetty et al. |
| 2015/0105539 A1 | 4/2015 | Miao et al. |
| 2015/0105540 A1 | 4/2015 | Miao et al. |
| 2015/0111954 A1 | 4/2015 | Sliz et al. |
| 2015/0141492 A1 | 5/2015 | Tuschl et al. |
| 2015/0211006 A1 | 7/2015 | Butler et al. |
| 2015/0238516 A1 | 8/2015 | Dowdy et al. |
| 2015/0275212 A1 | 10/2015 | Albaek et al. |
| 2015/0366987 A1 | 12/2015 | Bodyak et al. |
| 2016/0030332 A1 | 2/2016 | Lee et al. |
| 2016/0032288 A1 | 2/2016 | Tuschl et al. |
| 2016/0102148 A1 | 4/2016 | Park et al. |
| 2016/0193354 A1 | 7/2016 | Noe et al. |
| 2016/0304874 A1 | 10/2016 | Krauss |
| 2017/0081425 A1 | 3/2017 | Colletti et al. |
| 2017/0281795 A1 | 10/2017 | Geall et al. |

FOREIGN PATENT DOCUMENTS

| | | | |
|---|---|---|---|
| EP | 1214945 B1 | 6/2005 | |
| EP | 1579015 A2 | 9/2005 | |
| EP | 1352061 B1 | 5/2006 | |
| EP | 1742958 A2 | 1/2007 | |
| EP | 1407044 B1 | 9/2007 | |
| EP | 1550719 B1 | 12/2008 | |
| EP | 1349927 B1 | 3/2010 | |
| EP | 1409670 B1 | 10/2010 | |
| EP | 1633890 B1 | 10/2010 | |
| EP | 2336317 A1 | 6/2011 | |
| EP | 2361923 A2 | 8/2011 | |
| EP | 1608733 B1 | 12/2011 | |
| EP | 1873259 B1 | 1/2012 | |
| EP | 2514758 A1 | 10/2012 | |
| EP | 2580326 A1 | 4/2013 | |
| EP | 2351852 B1 | 10/2013 | |
| EP | 2195428 B1 | 12/2013 | |
| EP | 2028278 B1 | 3/2014 | |
| EP | 2348133 B1 | 7/2014 | |
| EP | 1633770 B1 | 4/2015 | |
| EP | 2340310 B1 | 6/2015 | |
| EP | 2949752 A2 | 12/2015 | |
| EP | 2548962 B1 | 1/2016 | |
| EP | 2813582 B1 | 4/2017 | |
| WO | WO-9734631 A1 | 9/1997 | |
| WO | WO-2006128138 A2 | 11/2006 | |
| WO | WO-2007021142 A1 | 2/2007 | |
| WO | WO-2008036127 A2 | 3/2008 | |
| WO | WO-2009099942 A2 | 8/2009 | |
| WO | WO-2009108217 A2 | 9/2009 | |
| WO | WO-2009126933 A2 | 10/2009 | |
| WO | WO-2009129281 A2 | 10/2009 | |
| WO | WO-2011009624 A1 * | 1/2011 | .......... C12N 15/111 |
| WO | WO-2013166004 A2 | 11/2013 | |

(56) References Cited

FOREIGN PATENT DOCUMENTS

| WO | WO-2013166155 A1 | 11/2013 |
|---|---|---|
| WO | WO-2014080251 A1 | 5/2014 |
| WO | WO-2014140317 A2 | 9/2014 |
| WO | WO-2014145090 A1 | 9/2014 |
| WO | WO-2014154835 A2 | 10/2014 |
| WO | WO-2014177042 A1 | 11/2014 |
| WO | WO-2014197854 A1 | 12/2014 |
| WO | WO-2015038426 A1 | 3/2015 |
| WO | WO-2015057699 A2 | 4/2015 |
| WO | WO-2015069587 A2 | 5/2015 |
| WO | WO-2015084846 A1 | 6/2015 |
| WO | WO-2015107425 A2 | 7/2015 |
| WO | WO-2015113922 A1 | 8/2015 |
| WO | WO-2015200223 A1 | 12/2015 |
| WO | WO-2016028649 A1 | 2/2016 |
| WO | WO-2017173408 A1 | 10/2017 |
| WO | WO-2017221883 A1 | 12/2017 |

OTHER PUBLICATIONS

Yazdi et al, Cancer Research, 1995, vol. 55, pp. 3763-3771 (Year: 1995).*
Abramova et al. Novel oligonucleotide analogues based on morpholino nucleoside subunits-antisense technologies: new chemical possibilities. Indian Journal of Chemistry 48B:1721-1726 (2009).
Agarwal et al. A Pictet-Spengler ligation for protein chemical modification. PNAS 110(1):46-51 (2013).
Axup et al. Synthesis of site-specific antibody-drug conjugates using unnatural amino acids. PNAS 109(40):16101-16106 (2012).
Baumer et al. Antibody-mediated delivery of anti-KRAS-siRNA in vivo overcomes therapy resistance in colon cancer. Clin Can Res 21(6):1383-1394 (2015).
Bell et al. Epidermal Growth Factor Receptor Mutations and Gene Amplification in Non-Small-Cell Lung Cancer: Molecular Analysis of the IDEAL/INTACT Gefitinib Trials. J Clin Oncol 23(31):8081-8092 (2005).
Bird et al. Single-chain antigen-binding proteins. Science 242:423-442 (1988).
Blaney et al. Traceless solid-phase organic synthesis. Chem. Rev. 102:2607-2024 (2002.
Bulmus et al. A new pH-responsive and glutathione-reactive, endosomal membrane-disruptive polymeric carrier for intracellular delivery of biomolecular drugs. J Controlled Release 93:105-120 (2003).
Burke et al. iRNA-mediated knockdown of P450 oxidoreductase in rats: a tool to reduce metabolism by CYPs and increase exposure of high clearance compounds. Pharm. Res. 31(12):3445-3460 (2014).
Casi et al. Site-specific traceless coupling of potent cytotoxic drugs to recombinant antibodies for pharmacodelivery. J Am Chem Soc 134(13):5887-5892 (2012).
Castaneda et al. Acid-cleavable thiomaleamic acid linker for homogeneous antibody-drug conjugation, Chem. Commun. 49:8187-8189 (2013).
Chen et al. Strand-specific 5'-O-methylation of siRNA duplexes controls guide strand selection and targeting specificity. RNA 14:263-274 (2008).
Clackson et al. Making antibody fragments using phage display libraries. Nature 352(6336):624-628 (1991).
Colberre-Garapin et al. A new dominant hybrid selective marker for higher eukaryotic cells. J Mol Biol 150:1-14 (1981).
Cole et al. The EBV-hybridoma technique and its application to human lung cancer. In, Monoclonal Antibodies and Cancer Therapy (vol. 27, UCLA Symposia on Molecular and Cellular Biology, New Series) (eds. R.A. Reisfeld and S.Sell), New York: Alan R. Liss, Inc. pp. 77-96 (1985).
Co-pending U.S. Appl. No. 16/128,393, filed Sep. 11, 2018.
Co-pending U.S. Appl. No. 16/128,417, filed Sep. 11, 2018.
Co-pending U.S. Appl. No. 16/128,428, filed Sep. 11, 2018.
Co-pending U.S. Appl. No. 16/128,440, filed Sep. 11, 2018.
Crouse et al. Expression and amplification of engineered mouse dihydrofolate reductase minigenes. Mol Cell Biol 3(2):257-266 (1983).
Cuellar et al. Systematic evaluation of antibody-mediated siRNA delivery using an industrial platform of THIOMAB—siRNA conjugates. Nucleic Acids Res 43(2):1189-1203 (2015).
Dawson et al. Modulation of Reactivity in Native Chemical Ligation through the Use of Thiol Additives. J. Am. Chem. Soc. 119:4325-4329 (1997).
Dawson et al. Synthesis of proteins by native chemical ligation. Science 266(5186):776-779 (1994).
Deleavey et al. Designing chemically modified oligonucleotides for targeted gene silencing. Chem Biol. 19(8):937-954 (2012).
Dietel et al. A 2015 update on predictive molecular pathology and its role in targeted cancer therapy: a review focussing on clinical relevance. Cancer Gene Ther 22(9):417-430 (2015).
Dimasi et al. Development of a trispecific antibody designed to simultaneously and efficiently target three different antigens on tumor cells. Mol Pharm 12(9):3490-3501 (2015).
Duncan et al. A polymer-Triton X-100 conjugate capable of pH-dependent red blood cell lysis: a model system illustrating the possibility of drug delivery within acidic intracellular compartments. J Drug Target 2:341-347 (1994).
El-Sayed et al. Rational design of composition and activity correlations for pH-responsive and glutathione-reactive polymer therapeutics. J Control Release 104:417-427 (2005).
Gaziova et al. Chemically defined polyethylene glycol siRNA conjugates with enhanced gene silencing effect. Bioorg Med Chem 22(7):2320-2326 (2014).
Goldspiel et al. Human gene therapy. Clin Pharm 12:488-505 (1993).
Griffey et al. 2'-0-aminopropyl ribonucleotides: a zwitterionic modification that enhances the exonuclease resistance and biological activity of antisense oligonucleotides, J. Med. Chem. 39(26):5100-5109 (1997).
Hackeng et al. Protein synthesis by native chemical ligation: Expanded scope by using straightforward methodology. PNAS USA 96:10068-10073 (1999).
Hanes et al. In vitro selection and evolution of functional proteins by using ribosome display. PNAS USA 94:4937-4942 (1997).
Hejesen et al. A traceless aryl-triazene linker for DNA-directed chemistry. Org Biomol Chem 11(15):2493-2497 (2013).
Henry et al. pH-responsive poly(styrene-alt-maleic anhydride) alkylamide copolymers for intracellular drug delivery. Biomacromolecules 7:2407-2414 (2006).
Hu et al. Site-specific Antibody-polymer Conjugates for siRNA Delivery. J Am Chem Soc 135(37):13885-13891 (2013).
Huang et al. Mechanisms of resistance to EGFR tyrosine kinase inhibitors. Acta Pharma Sinica B 5(5):390-401 (2015).
Huse et al. Generation of a large combinatorial library of the immunoglobulin repertoire in phage lambda. Science 246(4935):1275-1281 (1989).
Huston et al. Protein engineering of antibody binding sites: recovery of specific activity in an anti-digoxin single-chain Fv analogue produced in *Escherichia coli*. PNAS USA 85(16):5879-5883 (1988).
Iversen et al. Optimized siRNA-PEG conjugates for extended blood circulation and reduced urine excretion in mice. Theranostics 3(3):201-209 (2013).
Jancik et al. Clinical relevance of KRAS in human cancers. J Biomed Biotechnol 2010:150960 (13 pgs.) (2010).
Jones et al. Poly(2-alkylacrylic acid) polymers deliver molecules to the cytosol by pH-sensitive disruption of endosomal vesicles. Biochem J 372:65-75 (2003).
Kim et al. PEG conjugated VEGF siRNA for anti-angiogenic gene therapy. J Cont Rel 116:123-129 (2006).
Kohler et al. Continuous cultures of fused cells secreting antibody of predefined specificity. Nature 256:495-497 (1975).
Koizumi. ENA oligonucleotides as therapeutics. Curr Opin Mol Ther 8(2):144-149 (2006).
Kontermann et al. Bispecific antibodies. Drug Discov Today 20(7):838-847 (2015).
Kozbor et al. The production of monoclonal antibodies from human lymphocytes. Immunology Today 4:72-79 (1983).

(56) References Cited

OTHER PUBLICATIONS

Kutmeier et al. Assembly of humanized antibody genes from synthetic oligonucleotides using a single-round PCR. BioTechniques 17:242 (1994).
Leigh et al. The Human Plasma Proteome: History, Character, and Diagnostic Prospects. Mol Cell Proteomics 1:845-867 (2002).
Loh et al. A Survey of siRNA Nanoscal Delivery Patents. 11 Nanotechnology Law & Bus. (pp. 29-37) (2014).
Lowy et al. Isolation of transforming DNA: Cloning the hamster aprt gene. Cell 22:817-823 (1980).
Lyon et al. Self-hydrolyzing maleimides improve the stability and pharmacological properties of antibody-drug conjugates. Nat. Biotechnol. 32(10):1059-1062 (2014).
Morgan et al. Human gene therapy. Ann Rev Biochem 62:191-217 (1993).
Morrison et al. Chimeric human antibody molecules: mouse antigen-binding domains with human constant region domains. PNAS USA 81(21):6851-6855 (1984).
Mulligan. The basic science of gene therapy. Science 260(5110):926-932 (1993).
Naisbitt et al. Disposition of amodiaquine and related antimalarial agents in human neutrophils: implications for drug design. J Pharmacol Exp Ther 280:884-893 (1997).
Neuberger et al. Recombinant antibodies possessing novel effector functions. Nature 312(5995):604-608 (1984).
Obika et al. Synthesis of 2'-0,4'-C-methyleneuridine and—cytidine. Novel bicyclic nucleosides having a fixed C3'-endo sugar puckering. Tetrahedron Lett. 38(50):8735-8738 (1997).
O'Hare et al. Transformation of mouse fibroblasts to methotrexate resistance by a recombinant plasmid expressing a prokaryotic dihydrofolate reductase. PNAS USA 78:1527-1531 (1981).
PCT/US2017/025608 International Search Report and Written Opinion dated Jul. 10, 2017.
Phimister. Targeting Therapeutic Oligonucleotides. N Engl J Med 376:86-88 (2017).
Rozema et al. Dynamic PolyConjugates for targeted in vivo delivery of siRNA to hepatocytes. PNAS USA 104(32):12982-12987 (2007).
Santerre et al. Expression of prokaryotic genes for hygromycin B and G418 resistance as dominant-selection markers in mouse L cells. Gene 30(1-3):147-156 (1984).
Singh et al. Recent developments in oligonucleotide conjugation. Chem Soc Rev 39(6):2054-2070 (2010).
Skerra et al. Assembly of a functional Immunoglobulin Fv fragment in *Escherichia coli*. Science 240(4855):1038-1041 (1988).
Strop et al. Location matters: site of conjugation modulates stability and pharmacokinetics of antibody drug conjugates. Chem Biol 20(2):161-167 (2013).
Suriano et al. Beta-catenin (CTNNB1) gene amplification: a new mechanism of protein overexpression in cancer. Genes Chromosomes Cancer 42(3):238-246 (2005).
Szybalska et al. Genetics of human cell line. IV. DNA-mediated heritable transformation of a biochemical trait. PNAS USA 48:2026-2034 (1962).
Takeda et al. Construction of chimaeric processed immunoglobulin genes containing mouse variable and human constant region sequences. Nature 314(6010):452-454 (1985).
Talasila et al. EGFR Wild-type Amplification and Activation Promote Invasion and Development of Glioblastoma Independent of Angiogenesis. Acta Neuropathol. 125(5):683-698 (2013).
Tolstoshev. Gene Therapy, Concepts, Current Trials and Future Directions. Ann. Rev. Pharmacol. Toxicol. 32:573-596 (1993).
U.S. Appl. No. 15/473,849 1st Action Interview dated Nov. 24, 2017.
U.S. Appl. No. 15/476,849 1st Action Interview dated Sep. 11, 2017.
U.S. Appl. No. 15/476,849 Office Action dated Apr. 17, 2018.
U.S. Appl. No. 15/476,849 Office Action dated May 2, 2018.
Valtorta et al. KRAS gene amplification in colorectal cancer and impact on response to EGFR-targeted therapy. Int J Cancer 133:1259-1266 (2013).
Ward et al. Binding activities of a repertoire of single immunoglobulin variable domains secreted from *Escherichia coli*. Nature 341(6242):544-546 (1989).
Watts et al. Chemically modified siRNA: tools and applications. Drug Discov Today 13(19-20):842-855 (2008).
Wigler et al. Transfer of purified herpes virus thymidine kinase gene to cultured mouse cells. Cell 11:223-232 (1977).
Wigler et al. Transformation of mammalian cells with an amplifiable dominant-acting gene. PNAS USA 77:3567-3570 (1980).
Wong et al. Co-injection of a targeted, reversibly masked endosomolytic polymer dramatically improves the efficacy of cholesterol-conjugated small interfering RNAs in vivo. Nucleic Acid Ther 22(6):380-390 (2012).
Wu et al. Building complex glycopeptides: Development of a cysteine-free native chemical ligation protocol. Angew. Chem. Int. Ed. 45:4116-4125 (2006).
Wu et al. Delivery systems for gene therapy. Biotherapy 3:87-95 (1991).
Wu et al. Site-specific chemical modification of recombinant proteins produced in mammalian cells by using the genetically encoded aldehyde tag. PNAS USA 106(9):3000-3005 (2009).
Xu et al. Delivery systems for siRNA drug development in cancer therapy. Asian Journal of Pharmaceutical Sciences 10(1):1-12 (2015).
Yessine et al. Characterization of the membrane-destabilizing properties of different pH-sensitive methacrylic acid copolymers. Biochimica et Biophysica Acta 1613:28-38 (2003).
Albarran et al. Efficient intracellular delivery of a pro-apoptotic peptide with a pH-responsive carrier. React Funct Polym 71:261-265 (2011).
Flanary et al. Antigen delivery with poly(propylacrylic acid) conjugation enhanced MHC-1 presentation and T-cell activation. Bioconjugate Chem. 20:241-248 (2009).
Mcenaney et al. Antibody-recruiting molecules: an emerging paradigm for engaging immune function in treating human disease. ACS Chem Biol. 7(7):1139-1151 (2012).
U.S. Appl. No. 16/128,440 Office Action dated Nov. 9, 2018.
Winkler. Oligonucleotide conjugates for therapeutic applications. Ther Del 4(7):791-809 (2013).
Zhang et al. A remote arene-binding site on prostate specific membrane antigen revealed by antibody-recruiting small molecules. J Am Chem Soc. 132(36):12711-12716 (2010).
Khormaee et al. Edosomolytic anionic polymer for the cytoplasmic delivery of siRNAs in localized in vivo applications. Adv Funct Mater 23:565-574 (2013).
Feener et al. Alternative splicing of human dystrophin mRNA generates isoforms at the carboxy terminus. Nature 338:509-511 (Apr. 6, 1989).
Summerton, et al. Morpholino antisense oligomers: design, preparation, and properties.Antisense Nucleic Acid Drug Dev. Jun. 1997;7(3):187-95.
U.S. Appl. No. 16/128,440 Office Action dated May 30, 2019.
U.S. Appl. No. 16/128,450 Office Action dated Apr. 19, 2019.
U.S. Appl. No. 16/129,696 Office Action dated Apr. 17, 2019.
Walker et al. Improved cellular delivery of antisense oligonucleotides using transferrin receptor antibody-oligonucleotide conjugates. Pharmaceutical research 12(10):1548-1553 (1995).

\* cited by examiner (SEQ ID NO: 2055)

(SEQ ID NO: 2060)

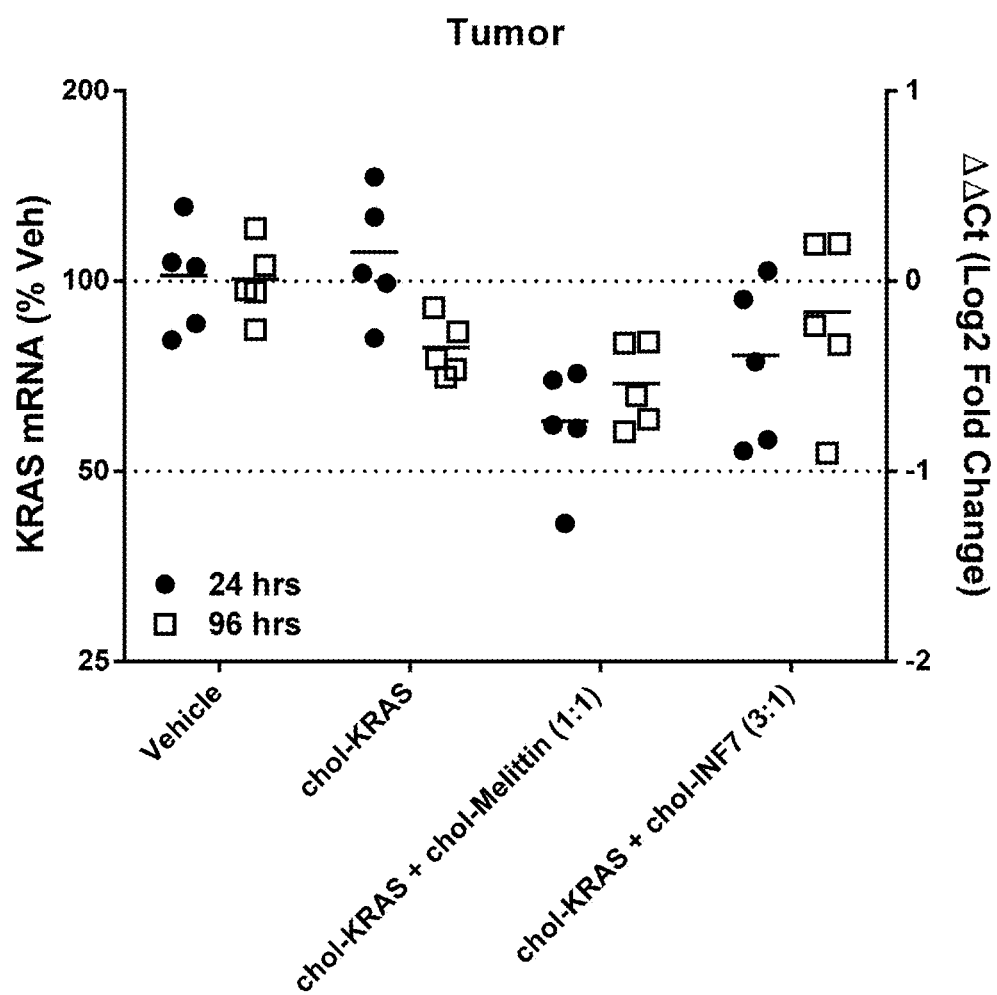

FIG. 54

1. Examples of different A's (mAbs and Fabs)
2. Examples of different B's (siRNA targets)

| mAb | Protein target | Cell type | siRNA target | | | | |
|---|---|---|---|---|---|---|---|
| | | | AR | EGFR | GAPDH | AR | LNCaP |
| Zalutumumab* | Human EGFR | | √ PK 237-HCC827 | √ PK/PD, PK 199 HCC827 and PK239-HCC827 | | | |
| Panitumumab* | Human EGFR | | PK 129-WT | √ PK/PD, PK 199 HCC827 | | | |
| Herceptin | Human EGFR | | | √ PK/PD, PK 234 HCC827 and PK 236 | | | |
| ANT4044* | Human PSMA | | | √ PK 129-WT, PK 123-LNCaP | | √ PK 160 LNCaP | |
| mASGR* | Mouse ASGR | √ B cells | √ PK 233-WT | | √ PK 257-WT | | |
| CD71* (Fab) | Mouse transferrin | | | | √ PK 245-WT | | √ PK 259-WT, PK 234-WT |

√ - Tested *in vitro*
√ - Tested *in vivo*

PK-237-HCC827; 0.5 mg/kg

PK-237-HCC827; 0.5 mg/kg

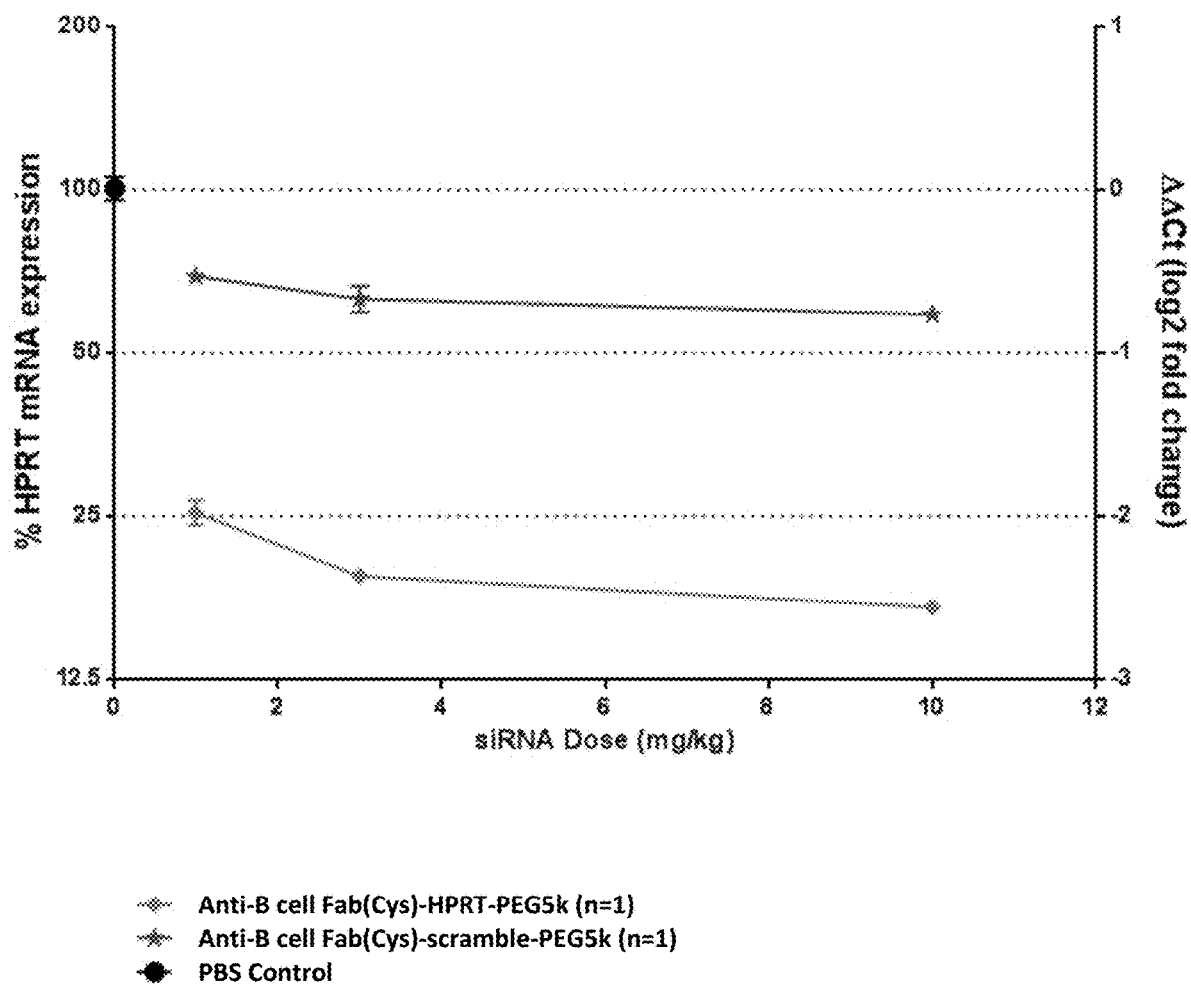

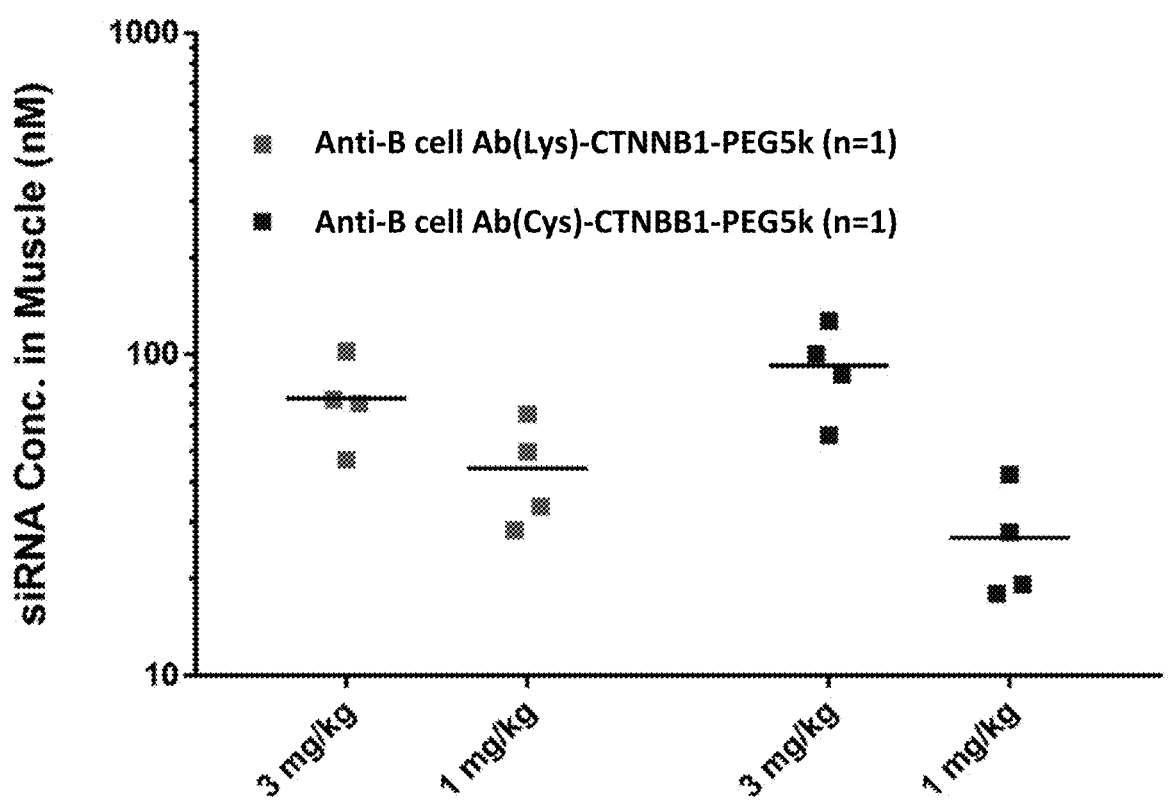

— Anti-B cell Fab(Cys)-scramble-PEG5k (n=1)
— Anti-B cell Fab(Cys)-HPRT-PEG5k (n=1)
— Vehicle — Vehicle
— Anti-B cell Fab(Cys)-scramble-PEG5k (n=1)
— Anti-B cell Fab(Cys)-HPRT-PEG5k (n=1)
— Anti-B cell mAb

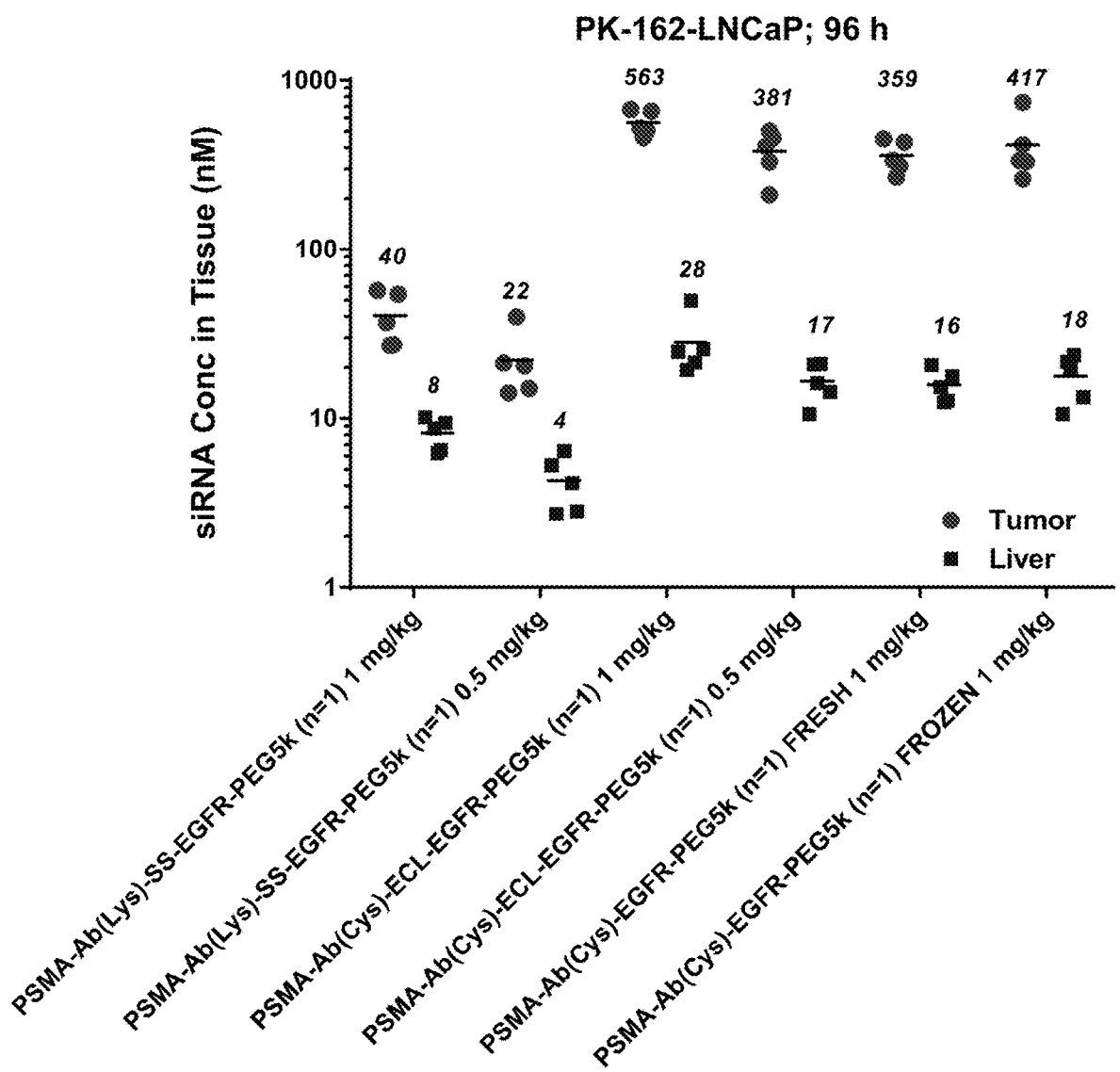

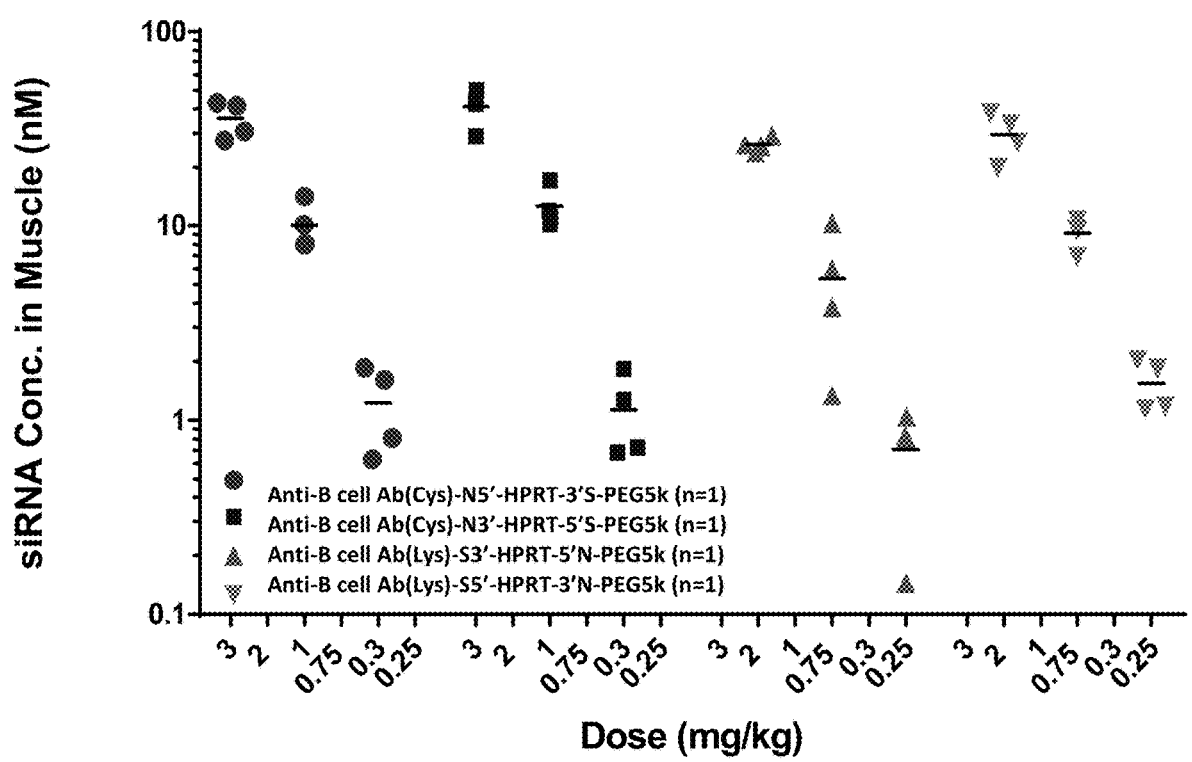

NUCLEIC ACID-POLYPEPTIDE COMPOSITIONS AND USES THEREOF

CROSS-REFERENCE

This application is a continuation of U.S. application Ser. No. 16/128,440, filed Sep. 11, 2018, which is a continuation of the International Application No. PCT/US2017/025608, filed Mar. 31, 2017, which claims the benefit of U.S. Provisional Application No. 62/316,919, filed Apr. 1, 2016, which application is incorporated herein by reference.

SEQUENCE LISTING

The instant application contains a Sequence Listing which has been submitted electronically in ASCII format and is hereby incorporated by reference in its entirety. Said ASCII copy, created on Sep. 12, 2018, is named 45532-707_302_SL.txt and is 615,757 bytes in size.

BACKGROUND OF THE DISCLOSURE

Gene suppression by RNA-induced gene silencing provides several levels of control: transcription inactivation, small interfering RNA (siRNA)-induced mRNA degradation, and siRNA-induced transcriptional attenuation. In some instances, RNA interference (RNAi) provides long lasting effect over multiple cell divisions. As such, RNAi represents a viable method useful for drug target validation, gene function analysis, pathway analysis, and disease therapeutics.

SUMMARY OF THE DISCLOSURE

Disclosed herein, in certain embodiments, are compositions and pharmaceutical formulations that comprise a binding moiety conjugated to a polynucleic acid molecule and a polymer. In some embodiments, also described herein include methods for treating a disease or condition (e.g., cancer) that utilize a composition or a pharmaceutical formulation comprising a binding moiety conjugated to a polynucleic acid molecule and a polymer.

Disclosed herein, in certain embodiments, is a molecule of Formula (I):

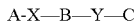  Formula I wherein,
  A is a binding moiety;
  B is a polynucleotide;
  C is a polymer;
  X is a bond or first linker; and
  Y is a bond or second linker; and
wherein the polynucleotide comprises at least one 2' modified nucleotide, at least one modified internucleotide linkage, or at least one inverted abasic moiety.

In some embodiments, the at least one 2' modified nucleotide comprises 2'-O-methyl, 2'-O-methoxyethyl (2'-O-MOE), 2'-O-aminopropyl, 2'-deoxy, T-deoxy-2'-fluoro, 2'-O-aminopropyl (2'-O-AP), 2'-O-dimethylaminoethyl (2'-O-DMAOE), 2'-O-dimethylaminopropyl (2'-O-DMAP), T-O-dimethylaminoethyloxyethyl (2'-O-DMAEOE), or 2'-O—N-methylacetamido (2'-O-NMA) modified nucleotide. In some embodiments, the at least one 2' modified nucleotide comprises locked nucleic acid (LNA) or ethylene nucleic acid (ENA). In some embodiments, the at least one modified internucleotide linkage comprises a phosphorothioate linkage or a phosphorodithioate linkage. In some embodiments, the at least one inverted abasic moiety is at at least one terminus.

In some embodiments, the polynucleotide comprises a single strand. In some embodiments, the polynucleotide comprises two or more strands. In some embodiments, the polynucleotide comprises a first polynucleotide and a second polynucleotide hybridized to the first polynucleotide to form a double-stranded polynucleic acid molecule. In some embodiments, the second polynucleotide comprises at least one modification.

In some embodiments, the first polynucleotide and the second polynucleotide are RNA molecules. In some embodiments, the first polynucleotide and the second polynucleotide are siRNA molecules.

In some embodiments, the first polynucleotide comprises a sequence having at least 60%, 65%, 70%, 75%, 80%, 85%, 90%, 95%, 96%, 97%, 98%, 99%, or 100% sequence identity to SEQ ID NOs: 16-75, 452-1955, 1956-1962, 1967-2002, 2013-2032, 2082-2109, or 2117. In some embodiments, the first polynucleotide consists of a sequence selected from SEQ ID NOs: 16-75, 452-1955, 1956-1962, 1967-2002, 2013-2032, 2082-2109, or 2117.

In some embodiments, the second polynucleotide comprises a sequence having at least 60%, 65%, 70%, 75%, 80%, 85%, 90%, 95%, 96%, 97%, 98%, 99%, or 100% sequence identity to SEQ ID NOs: 16-75, 452-1955, 1956-1962, 1967-2002, 2013-2032, 2082-2109, or 2117. In some embodiments, the second polynucleotide consists of a sequence selected from SEQ ID NOs: 16-75, 452-1955, 1956-1962, 1967-2002, 2013-2032, 2082-2109, or 2117.

In some embodiments, X and Y are independently a bond or a non-polymeric linker group. In some embodiments, X is a bond. In some embodiments, X is a $C_1$-$C_6$ alkyl group. In some embodiments, Y is a $C_1$-$C_6$ alkyl group. In some embodiments, X is a homobifunctional linker or a heterobifunctional linker, optionally conjugated to a $C_1$-$C_6$ alkyl group. In some embodiments, Y is a homobifunctional linker or a heterobifunctional linker.

In some embodiments, the binding moiety is an antibody or binding fragment thereof. In some embodiments, the antibody or binding fragment thereof comprises a humanized antibody or binding fragment thereof, chimeric antibody or binding fragment thereof, monoclonal antibody or binding fragment thereof, monovalent Fab', divalent Fab2, single-chain variable fragment (scFv), diabody, minibody, nanobody, single-domain antibody (sdAb), or camelid antibody or binding fragment thereof. In some embodiments, the antibody or binding fragment thereof is an anti-EGFR antibody or binding fragment thereof.

In some embodiments, C is polyethylene glycol. In some embodiments, C has a molecular weight of about 5000 Da.

In some embodiments, A-X is conjugated to the 5' end of B and Y—C is conjugated to the 3' end of B. In some embodiments, Y—C is conjugated to the 5' end of B and A-X is conjugated to the 3' end of B. In some embodiments, A-X, Y—C or a combination thereof is conjugated to an internucleotide linkage group.

In some embodiments, the molecule further comprises D. In some embodiments, D is conjugated to C or to A.

In some embodiments, D is conjugated to the molecule of Formula (I) according to Formula (II):

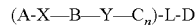  Formula II wherein,
  A is a binding moiety;
  B is a polynucleotide;

C is a polymer;
X is a bond or first linker;
Y is a bond or second linker;
L is a bond or third linker;
D is an endosomolytic moiety; and
n is an integer between 0 and 1; and
wherein the polynucleotide comprises at least one 2' modified nucleotide, at least one modified internucleotide linkage, or at least one inverted abasic moiety; and D is conjugated anywhere on A, B, or C.

In some embodiments, D is INF7 or melittin. In some embodiments, D is an endosomolytic polymer. In some embodiments, L is a $C_1$-$C_6$ alkyl group. In some embodiments, L is a homobifuctional linker or a heterobifunctional linker.

In some embodiments, the molecule further comprises at least a second binding moiety A. In some embodiments, the at least second binding moiety A is conjugated to A, to B, or to C. In some embodiments, the at least second binding moiety A is cholesterol.

In some embodiments, the molecule further comprises at least an additional polynucleotide B. In some embodiments, the at least an additional polynucleotide B is conjugated to A, to B, or to C.

In some embodiments, the molecule further comprises at least an additional polymer C. In some embodiments, the at least an additional polymer C is conjugated to A, to B, or to C.

Disclosed herein, in certain embodiments, is a molecule of Formula (I): A-X—B—Y—C (Formula I), wherein A is an antibody or its binding fragments thereof; B is a polynucleotide; C is a polymer; X is a bond or first non-polymeric linker; and Y is a bond or second linker; wherein the polynucleotide comprises at least one 2' modified nucleotide, at least one modified internucleotide linkage, or at least one inverted abasic moiety; and wherein A and C are not attached to B at the same terminus. In some embodiments, the at least one 2' modified nucleotide comprises 2'-O-methyl, 2'-O-methoxyethyl (2'-O-MOE), 2'-O-aminopropyl, 2'-deoxy, T-deoxy-2'-fluoro, 2'-O-aminopropyl (2'-O-AP), 2'-O-dimethylaminoethyl (2'-O-DMAOE), 2'-O-dimethylaminopropyl (2'-O-DMAP), T-O-dimethylaminoethyloxyethyl (2'-O-DMAEOE), or 2'-O—N-methylacetamido (2'-O-NMA) modified nucleotide. In some embodiments, the at least one 2' modified nucleotide comprises locked nucleic acid (LNA) or ethylene nucleic acid (ENA). In some embodiments, the at least one modified internucleotide linkage comprises a phosphorothioate linkage or a phosphorodithioate linkage. In some embodiments, the at least one inverted abasic moiety is at at least one terminus. In some embodiments, the polynucleotide comprises a single strand. In some embodiments, the polynucleotide comprises a first polynucleotide and a second polynucleotide hybridized to the first polynucleotide to form a double-stranded polynucleic acid molecule. In some embodiments, the second polynucleotide comprises at least one modification. In some embodiments, the first polynucleotide and the second polynucleotide are RNA molecules. In some embodiments, the first polynucleotide comprises a sequence having at least 80%, 85%, 90%, 95%, 96%, 97%, 98%, 99%, or 100% sequence identity to SEQ ID NOs: 16-75, 452-1955, 1956-1962, 1967-2002, 2013-2032, 2082-2109, or 2117. In some embodiments, the second polynucleotide comprises a sequence having at least 80%, 85%, 90%, 95%, 96%, 97%, 98%, 99%, or 100% sequence identity to SEQ ID NOs: 16-75, 452-1955, 1956-1962, 1967-2002, 2013-2032, 2082-2109, or 2117. In some embodiments, Y is a non-polymeric linker group. In some embodiments, X is a bond. In some embodiments, X is a $C_1$-$C_6$ alkyl group. In some embodiments, Y is a $C_1$-$C_6$ alkyl group. In some embodiments, X is a homobifuctional linker or a heterobifunctional linker, optionally conjugated to a $C_1$-$C_6$ alkyl group. In some embodiments, Y is a homobifunctional linker or a heterobifunctional linker. In some embodiments, the antibody or binding fragment thereof comprises a humanized antibody or binding fragment thereof, chimeric antibody or binding fragment thereof, monoclonal antibody or binding fragment thereof, monovalent Fab', divalent Fab2, single-chain variable fragment (scFv), diabody, minibody, nanobody, single-domain antibody (sdAb), or camelid antibody or binding fragment thereof. In some embodiments, C is polyethylene glycol. In some embodiments, C has a molecular weight of about 1000 Da, 2000 Da, or 5000 Da. In some embodiments, A-X is conjugated to the 5' end of B and Y—C is conjugated to the 3' end of B. In some embodiments, Y—C is conjugated to the 5' end of B and A-X is conjugated to the 3' end of B. In some embodiments, the molecule further comprises D. In some embodiments, D is conjugated to C or to A. In some embodiments, D is conjugated to the molecule of Formula (I) according to Formula (II): (A-X—B—Y—$C_c$)-L-D (Formula II), wherein A is an antibody or its binding fragments thereof; B is a polynucleotide; C is a polymer; X is a bond or first non-polymeric linker; Y is a bond or second linker; L is a bond or third linker; D is an endosomolytic moiety; and c is an integer between 0 and 1; wherein the polynucleotide comprises at least one 2' modified nucleotide, at least one modified internucleotide linkage, or at least one inverted abasic moiety; wherein A and C are not attached to B at the same terminus; and wherein D is conjugated anywhere on A or C or to a terminus of B. In some embodiments, D is INF7 or melittin. In some embodiments, D is an endosomolytic polymer. In some embodiments, L is a $C_1$-$C_6$ alkyl group. In some embodiments, L is a homobifuctional linker or a heterobifunctional linker. In some embodiments, the molecule further comprises at least a second binding moiety. In some embodiments, the at least second binding moiety is conjugated to A, to B, or to C. In some embodiments, the at least second binding moiety is cholesterol. In some embodiments, the molecule further comprises at least an additional polynucleotide B. In some embodiments, the at least an additional polynucleotide B is conjugated to A, to B, or to C. In some embodiments, the molecule further comprises at least an additional polymer C. In some embodiments, the at least an additional polymer C is conjugated to A, to B, or to C.

Disclosed herein, in certain embodiments, is a pharmaceutical composition comprising a molecule described above, and a pharmaceutically acceptable excipient. In some embodiments, the pharmaceutical composition is formulated as a nanoparticle formulation. In some embodiments, the pharmaceutical composition is formulated for parenteral, oral, intranasal, buccal, rectal, or transdermal administration.

Disclosed herein, in certain embodiments, is a method of treating a disease or disorder in a patient in need thereof, comprising administering to the patient a composition comprising a molecule described above. In some embodiments, the disease or disorder is a cancer. In some embodiments, the cancer is a solid tumor. In some embodiments, the cancer is a hematologic malignancy. In some embodiments, the cancer comprises a KRAS-associated, an EGFR-associated, an AR-associated cancer, a β-catenin associated cancer, a PIK3C-associated cancer, or a MYC-associated cancer. In some embodiments, the cancer comprises bladder cancer, breast cancer, colorectal cancer, endometrial cancer, esophageal cancer, glioblastoma multiforme, head and neck cancer, kidney cancer, lung cancer, ovarian cancer, pancreatic cancer, prostate cancer, or thyroid cancer. In some embodiments, the cancer comprises acute myeloid leukemia, CLL, DLBCL, or multiple myeloma. In some embodiments, the method is an immuno-oncology therapy.

Disclosed herein, in certain embodiments, is a method of inhibiting the expression of a target gene in a primary cell of a patient, comprising administering a molecule described above to the primary cell. In some embodiments, the method is an in vivo method. In some embodiments, the patient is a human.

Disclosed herein, in certain embodiments, is an immuno-oncology therapy comprising a molecule described above for the treatment of a disease or disorder in a patient in need thereof.

Disclosed herein, in certain embodiments, is a kit comprising a molecule described above.

BRIEF DESCRIPTION OF THE DRAWINGS

Various aspects of the disclosure are set forth with particularity in the appended claims. A better understanding of the features and advantages of the present disclosure will be obtained by reference to the following detailed description that sets forth illustrative embodiments, in which the principles of the disclosure are utilized, and the accompanying drawings of which:

FIG. 26A shows tissue concentration-time profiles out to 168 h post-dose measured in s.c. flank H358 tumors in a mice model. FIG. 26B shows tissue concentration-time profiles out to 168 h post-dose measured in normal livers of mice.

FIG. 45 shows siRNA-mediated mRNA knockdown of mouse KRAS in human s.c. flank H358 tumors.

FIG. 54 illustrates exemplary As and Bs to generate molecules encompassed by Formula (I).

FIG. 65A-FIG. 65E illustrate mRNA expression level in heart (FIG. 65A), mRNA expression level in gastrointestinal tissue (FIG. 65B), mRNA expression level in liver (FIG. 65C), mRNA expression level in lung (FIG. 65D), and siRNA concentration in tissue (FIG. 65E) of exemplary molecules described herein.

FIG. 66A-FIG. 66D illustrate siRNA concentration in heart (FIG. 66A), mRNA expression level in heart (FIG. 66B), mRNA expression level in gastrointestinal tissue (FIG. 66C), and siRNA concentration in muscle (FIG. 66D).

FIG. 68A illustrates an anti-B cell Fab-siRNA conjugate. FIG. 68B shows an anti-B cell monoclonal antibody-siRNA conjugate.

FIG. 71A illustrates siRNA concentration of exemplary molecules described herein in LNCaP tomor.

76A shows the mRNA expression level in heart. FIG. 76B shows the mRNA expression level in muscle. FIG. 76C shows the mRNA expression level in liver. FIG. 76D shows the mRNA expression level in lung.

FIG. 77A-FIG. 77D illustrate siRNA concentrations of exemplary molecules encompassed by Formula (I) in muscle (FIG. 77A), heart (FIG. 77B), liver (FIG. 77C), and lung (FIG. 77D).

DETAILED DESCRIPTION OF THE DISCLOSURE

Figure 1A:
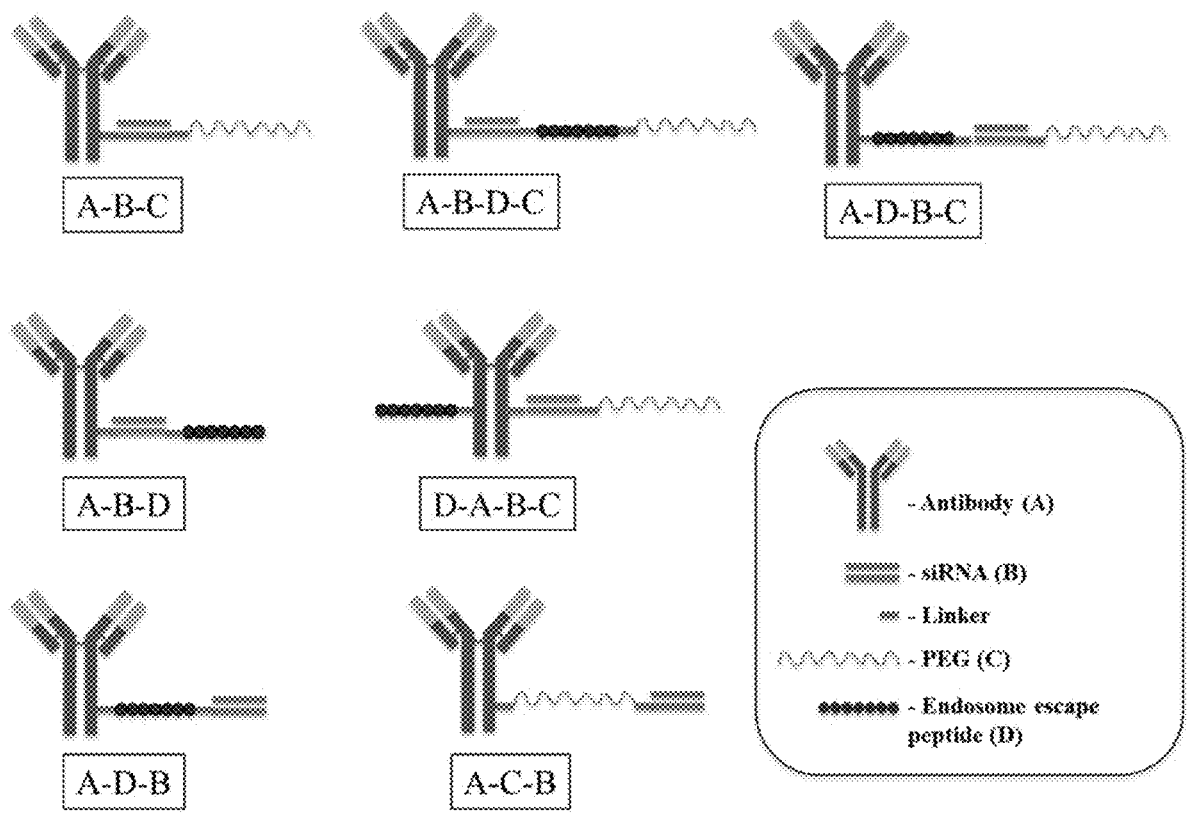
FIG. 1A-FIG. 1C illustrate cartoon representations of molecules described herein.

Nucleic acid (e.g., RNAi) therapy is a targeted therapy with high selectivity and specificity. However, in some instances, nucleic acid therapy is also hindered by poor intracellular uptake, limited blood stability and non-specific immune stimulation. To address these issues, various modifications of the nucleic acid composition are explored, such as for example, novel linkers for better stabilizing and/or lower toxicity, optimization of binding moiety for increased target specificity and/or target delivery, and nucleic acid polymer modifications for increased stability and/or reduced off-target effect.

In some embodiments, the arrangement or order of the different components that make-up the nucleic acid composition further effects intracellular uptake, stability, toxicity, efficacy, and/or non-specific immune stimulation. For example, if the nucleic acid component includes a binding moiety, a polymer, and a polynucleic acid molecule (or polynucleotide), the order or arrangement of the binding moiety, the polymer, and/or the polynucleic acid molecule (or polynucleotide) (e.g., binding moiety-polynucleic acid molecule-polymer, binding moiety-polymer-polynucleic acid molecule, or polymer-binding moiety-polynucleic acid molecule) further effects intracellular uptake, stability, toxicity, efficacy, and/or non-specific immune stimulation.

In some embodiments, described herein include a molecule those arrangement of the nucleic acid components effects intracellular uptake, stability, toxicity, efficacy, and/or non-specific immune stimulation. In some instances, the molecule comprises a binding moiety conjugated to a polynucleic acid molecule and a polymer. In some embodiments, the molecule comprises a molecule according to Formula (I): A-X—B—Y—C; in which A is a binding moiety, B is a polynucleotide, C is a polymer, X is a bond or first linker, and Y is a bond or second linker. In some instances, the polynucleotide comprises at least one 2' modified nucleotide, at least one modified internucleotide linkage, or at least one inverted abasic moiety. In some instances, the molecule of Formula (I) further comprises D, an endosomolytic moiety.

In some embodiments, a molecule comprising a binding moiety conjugated to a polynucleic acid molecule and a polymer arranged as described herein enhances intracellular uptake, stability, and/or efficacy. In some instances, a molecule comprising a binding moiety conjugated to a polynucleic acid molecule and a polymer arranged as described herein reduces toxicity and/or non-specific immune stimulation. In some cases, the molecule comprises a molecule according to Formula (I): A-X—B—Y—C; in which A is a binding moiety, B is a polynucleotide, C is a polymer, X is a bond or first linker, and Y is a bond or second linker. In some instances, the polynucleotide comprises at least one 2' modified nucleotide, at least one modified internucleotide linkage, or at least one inverted abasic moiety. In some instances, the molecule of Formula (I) further comprises D, an endosomolytic moiety.

In some embodiments, a molecule described herein is further used to treat a disease or disorder. In some instances, a molecule for the treatment of a disease or disorder is a molecule according to Formula (I): A-X—B—Y—C; in which A is a binding moiety, B is a polynucleotide, C is a polymer, X is a bond or first linker, and Y is a bond or second linker. In some instances, the polynucleotide comprises at least one 2' modified nucleotide, at least one modified internucleotide linkage, or at least one inverted abasic moiety. In some instances, the molecule of Formula (I) further comprises D, an endosomolytic moiety.

In some embodiments, a molecule described herein is also used for inhibiting the expression of a target gene in a primary cell of a patient in need thereof. In such instances, a molecule for such use is a molecule according to Formula (I): A-X—B—Y—C; in which A is a binding moiety, B is a polynucleotide, C is a polymer, X is a bond or first linker, and Y is a bond or second linker. In some instances, the polynucleotide comprises at least one 2' modified nucleotide, at least one modified internucleotide linkage, or at least one inverted abasic moiety. In some instances, the molecule of Formula (I) further comprises D, an endosomolytic moiety.

In some embodiments, a molecule described herein is additionally used as an immuno-oncology therapy for the treatment of a disease or disorder. In some instance, the molecule is a molecule according to Formula (I): A-X—B—Y—C; in which A is a binding moiety, B is a polynucleotide, C is a polymer, X is a bond or first linker, and Y is a bond or second linker. In some instances, the polynucleotide comprises at least one 2' modified nucleotide, at least one modified internucleotide linkage, or at least one inverted abasic moiety. In some instances, the molecule of Formula (I) further comprises D, an endosomolytic moiety.

In additional embodiments, described herein include a kit, which comprises one or more of the molecules described herein.

Therapeutic Molecule Platform

In some embodiments, a molecule (e.g., a therapeutic molecule) described herein comprises a binding moiety conjugated to a polynucleic acid molecule and a polymer. In some embodiments, a molecule (e.g., a therapeutic molecule) comprises a molecule according to Formula (I):

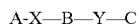  Formula I wherein,
  A is a binding moiety;
  B is a polynucleotide;
  C is a polymer;
  X is a bond or first linker; and
  Y is a bond or second linker; and
wherein the polynucleotide comprises at least one 2' modified nucleotide, at least one modified internucleotide linkage, or at least one inverted abasic moiety.

In some instances, the molecule of Formula (I) further comprises D, an endosomolytic moiety.

In some embodiments, at least one A and/or at least one C are conjugated to the 5' terminus of B, the 3' terminus of B, an internal site on B, or in any combinations thereof. In some instances, at least one A is conjugated at one terminus of B while at least one C is conjugated at the opposite terminus of B. In some instances, at least one of A is conjugated at one terminus of B while at least one of C is conjugated at an internal site on B.

In some cases, A and C are not conjugated or attached to B at the same terminus. In some cases, A is attached or conjugated to B at a first terminus of B. In some cases, C is attached or conjugated to B at a second terminus of B, and the second terminus of B is different than the first terminus. In some cases, A is attached or conjugated to B at the 5' terminus of B, and C is attached or conjugated to B at the 3' terminus of B. In other cases, A is attached or conjugated to B at the 3' terminus of B, and C is attached or conjugated to B at the 5' terminus of B.

In some embodiments, A is an antibody or binding fragment thereof. In some cases, C is a polymer. In some cases, A and C are not conjugated or attached to B at the same terminus. In some cases, A is attached or conjugated to B at a first terminus of B. In some cases, C is attached or conjugated to B at a second terminus of B, and the second terminus of B is different than the first terminus. In some cases, A is attached or conjugated to B at the 5' terminus of B, and C is attached or conjugated to B at the 3' terminus of B. In other cases, A is attached or conjugated to B at the 3' terminus of B, and C is attached or conjugated to B at the 5' terminus of B. In some cases, X which connects A to B is a bond or a non-polymeric linker. In some cases, X is a non-peptide linker (or a linker that does not comprise an amino acid residue). In some cases, Y which connects B to C is a bond or a second linker. In some instances, X connects A to the 5' terminus of B, and Y connects C to the 3' terminus of B. In other instances, X connects A to the 3' terminus of B, and Y connects C to the 5' terminus of B.

In some embodiments, X—B is conjugated or attached to the N-terminus, C-terminus, a constant region, a hinge region, or a Fc region of A. In some instances, X—B is conjugated or attached to the N-terminus of A. In some instances, X—B is conjugated or attached to the C-terminus of A. In some instances, X—B is conjugated or attached to a hinge region of A. In some instances, X—B is conjugated or attached to a constant region of A. In some instances, X—B is conjugated or attached to the Fc region of A.

In some instances, at least one B and/or at least one C, and optionally at least one D are conjugated to a first A. In some instances, the at least one B is conjugated at a terminus (e.g., a 5' terminus or a 3' terminus) to the first A or are conjugated via an internal site to the first A. In some cases, the at least one C is conjugated either directly to the first A or indirectly via the two or more Bs. If indirectly via the two or more Bs, the two or more Cs are conjugated either at the same terminus as the first A on B, at opposing terminus from the first A, or independently at an internal site. In some instances, at least one additional A is further conjugated to the first A, to B, or to C. In additional instances, the at least one D is optionally conjugated either directly or indirectly to the first A, to the at least one B, or to the at least one C. If directly to the first A, the at least one D is also optionally conjugated to the at least one B to form a A-D-B conjugate or is optionally conjugated to the at least one B and the at least one C to form a A-D-B—C conjugate. In some cases, the at least one additional A is different than the first A.

In some cases, two or more Bs and/or two or more Cs are conjugated to a first A. In some instances, the two or more Bs are conjugated at a terminus (e.g., a 5' terminus or a 3' terminus) to the first A or are conjugated via an internal site to the first A. In some instances, the two or more Cs are conjugated either directly to the first A or indirectly via the two or more Bs. If indirectly via the two or more Bs, the two or more Cs are conjugated either at the same terminus as the first A on B, at opposing terminus from the first A, or independently at an internal site. In some instances, at least one additional A is further conjugated to the first A, to two or more Bs, or to two or more Cs. In additional instances, at least one D is optionally conjugated either directly or indirectly to the first A, to the two or more Bs, or to the two or more Cs. If indirectly to the first A, the at least one D is conjugated to the first A through the two or more Bs, through the two or more Cs, through a B—C orientation to form a A-B—C-D type conjugate, or through a C—B orientation to form a A-C—B-D type conjugate. In some cases, the at least one additional A is different than the first A. In some cases, the two or more Bs are different. In other cases, the two or more Bs are the same. In some instances, the two or more Cs are different. In other instances, the two or more Cs are the same. In additional instances, the two or more Ds are different. In additional instances, the two or more Ds are the same.

In other cases, two or more Bs and/or two or more Ds, optionally two or more Cs are conjugated to a first A. In some instances, the two or more Bs are conjugated at a terminus (e.g., a 5' terminus or a 3' terminus) to the first A or are conjugated via an internal site to the first A. In some instances, the two or more Ds are conjugated either directly to the first A or indirectly via the two or more Bs. If indirectly via the two or more Bs, the two or more Ds are conjugated either at the same terminus as the first A on B, at opposing terminus from the first A, or independently at an internal site. In some instances, at least one additional A is further conjugated to the first A, to the two or more Bs, or to the two or more Ds. In additional instances, the two or more Cs are optionally conjugated either directly or indirectly to the first A, to the two or more Bs, or to the two or more Ds. In some cases, the at least one additional A is different than the first A. In some cases, the two or more Bs are different. In other cases, the two or more Bs are the same. In some instances, the two or more Cs are different. In other instances, the two or more Cs are the same. In additional instances, the two or more Ds are different. In additional instances, the two or more Ds are the same.

In some embodiments, a molecule (e.g., a therapeutic molecule) described herein comprises a molecule according to Formula (II):

(A-X—B—Y—C$_c$)-L-D      Formula II wherein,
A is a binding moiety;
B is a polynucleotide;
C is a polymer;
X is a bond or first linker;
Y is a bond or second linker;
L is a bond or third linker;
D is an endosomolytic moiety; and
c is an integer between 0 and 1; and
wherein the polynucleotide comprises at least one 2' modified nucleotide, at least one modified internucleotide linkage, or at least one inverted abasic moiety; and D is conjugated anywhere on A, B, or C.

In some embodiments, a molecule (e.g., a therapeutic molecule) described herein comprises a molecule according to Formula (III):

A$_a$-X—B$_b$—Y—C$_c$-L-D$_n$      Formula III wherein,
A is a binding moiety;
B is a polynucleotide;
C is a polymer;
D is an endosomolytic moiety;
X is a bond or first linker;
Y is a bond or second linker;
L is a bond or third linker;
a and b are independently an integer between 1-3;
c is an integer between 0 and 3; and
n is an integer between 0 and 10; and
wherein the polynucleotide comprises at least one 2' modified nucleotide, at least one modified internucleotide linkage, or at least one inverted abasic moiety; A is conjugated anywhere on B, C, or D; B is conjugated anywhere on A, C, or D; C is conjugated anywhere on A, B, or D; and D is conjugated anywhere on A, B, or C.

In some embodiments, a molecule (e.g., a therapeutic molecule) described herein comprises a molecule according to Formula (IIIa): A-X—B-L-D-Y—C.

In some embodiments, a molecule (e.g., a therapeutic molecule) described herein comprises a molecule according to Formula (IIIb): A$_a$-X—B$_b$-L-D$_n$.

In some embodiments, a molecule (e.g., a therapeutic molecule) described herein comprises a molecule according to Formula (IV):

A-X—(B$_b$—Y—C$_c$-L-D$_n$)$_m$ wherein,
A is a binding moiety;
B is a polynucleotide;
C is a polymer;
D is an endosomolytic moiety;
X is a bond or first linker;
Y is a bond or second linker;
L is a bond or third linker;
a and b are independently an integer between 1-3;
c is an integer between 0 and 3;
n is an integer between 0 and 10; and
m is an integer between 1-3; and
wherein the polynucleotide comprises at least one 2' modified nucleotide, at least one modified internucleotide linkage, or at least one inverted abasic moiety; C is conjugated anywhere on B or D; and D is conjugated anywhere on B or C.

In some embodiments, a molecule (e.g., a therapeutic molecule) described herein comprises a molecule according to Formula (IVa): A-X—(B$_b$— L-D$_n$-Y—C$_c$)$_m$.

Figure 1B:
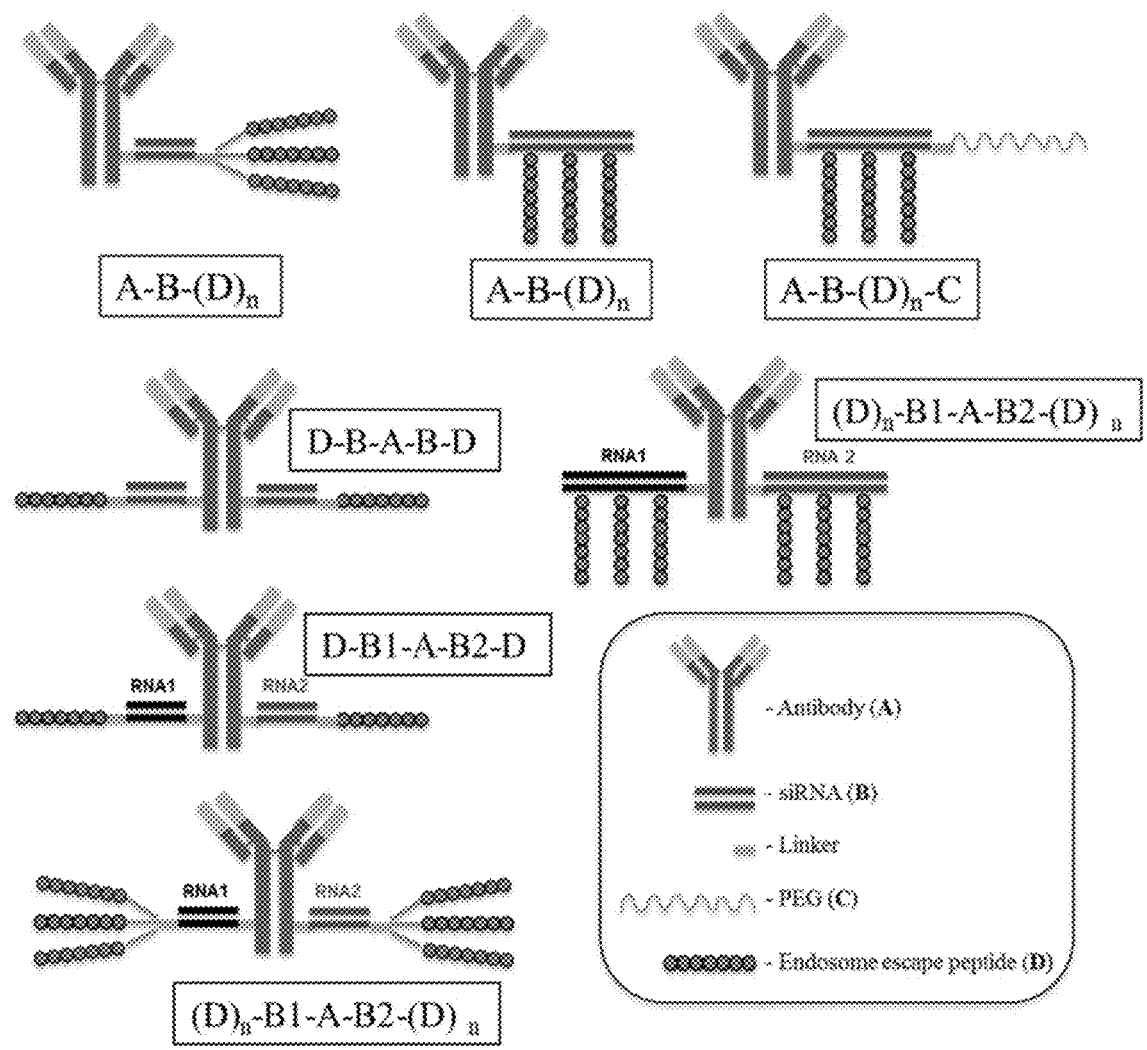
Figure 1C:
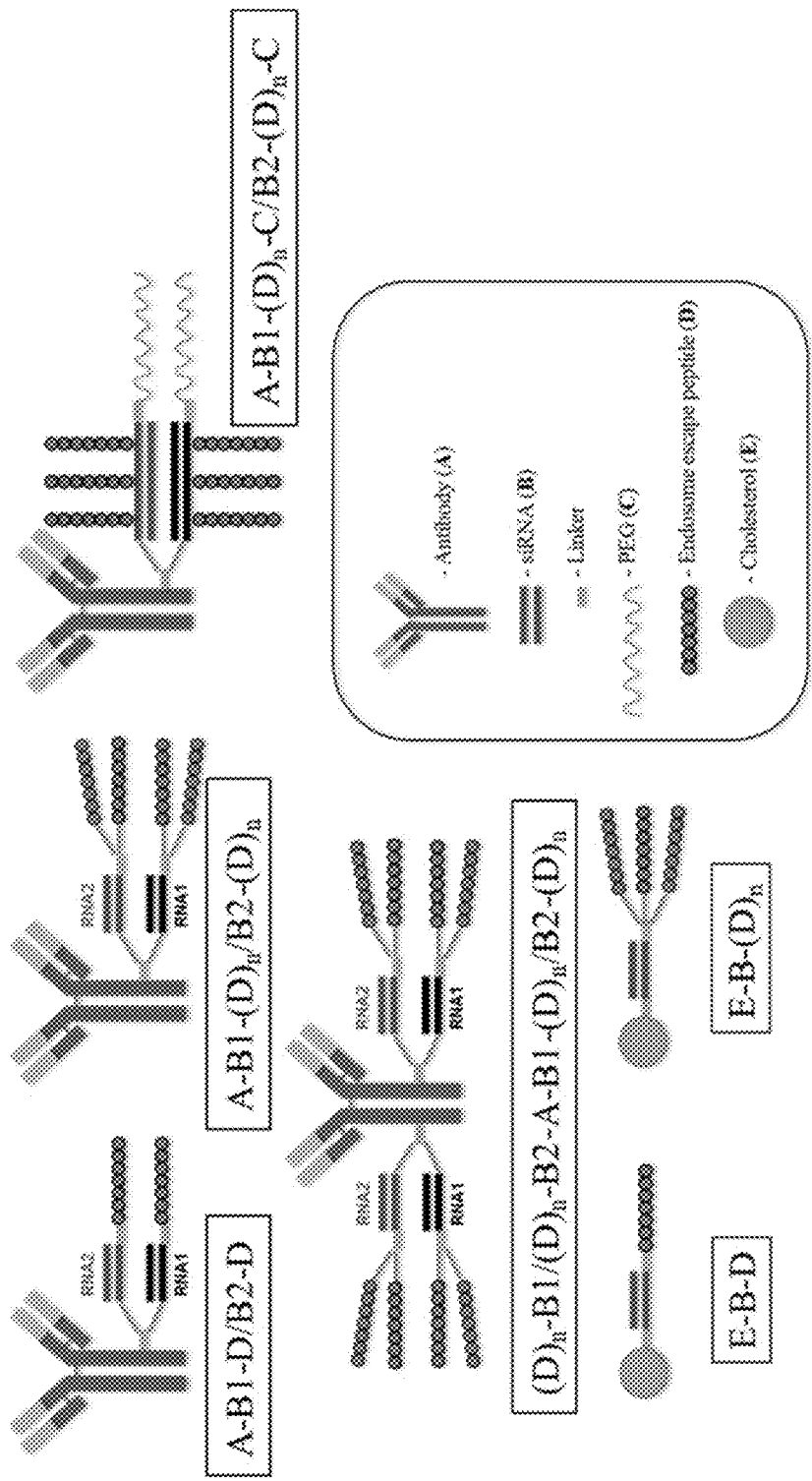

In some embodiment, a molecule (e.g., a therapeutic molecule) described herein is a molecule as illustrated in FIG. 1. In some instances, a molecule (e.g., a therapeutic molecule) described herein is a molecule as illustrated in FIG. 1A. In some cases, a molecule (e.g., a therapeutic molecule) described herein is a molecule as illustrated in FIG. 1B. In additional cases, a molecule (e.g., a therapeutic molecule) described herein is a molecule as illustrated in FIG. 1C.

In some embodiments, a molecule (e.g., a therapeutic molecule) is a molecule as illustrated[:] in FIG. 1A, by the molecule labeled "A-B—C".

In some embodiments, a molecule (e.g., a therapeutic molecule) is a molecule as illustrated[:] in FIG. 1A, by the molecule labeled "A-B-D-C".

In some embodiments, a molecule (e.g., a therapeutic molecule) is a molecule as illustrated[:] in FIG. 1A, by the molecule labeled "A-D-B—C".

In some embodiments, a molecule (e.g., a therapeutic molecule) is a molecule as illustrated[:] in FIG. 1A, by the molecule labeled "A-B-D".

In some embodiments, a molecule (e.g., a therapeutic molecule) is a molecule as illustrated[:] in FIG. 1A, by the molecule labeled "D-A-B-C".

In some embodiments, a molecule (e.g., a therapeutic molecule) is a molecule as illustrated[:] in FIG. 1A, by the molecule labeled "A-D-B".

In some embodiments, a molecule (e.g., a therapeutic molecule) is a molecule as illustrated[:] in FIG. 1A, by the molecule labeled "A-C-B".

In some embodiments, a molecule (e.g., a therapeutic molecule) is a molecule as illustrated[:] in FIG. 1B, by the molecule labeled "A-B-(D)$_n$", wherein Endosome escape peptides are attached at an end of the siRNA opposite the antibody.

In some embodiments, a molecule (e.g., a therapeutic molecule) is a molecule as illustrated[:] in FIG. 1B, by the molecule labeled "A-B-(D)$_n$", wherein Endosome escape peptides are attached along the length of the siRNA.

In some embodiments, a molecule (e.g., a therapeutic molecule) is a molecule as illustrated: in FIG. 1B, by the molecule labeled "A-B-(D)$_n$-C".

In some embodiments, a molecule (e.g., a therapeutic molecule) is a molecule as illustrated[:] in FIG. 1B, by the molecule labeled "D-B-A-B-D".

In some embodiments, a molecule (e.g., a therapeutic molecule) is a molecule as illustrated[:] in FIG. 1B, by the molecule labeled "(D)$_n$-B1-A-B2-(D)$_n$", wherein Endosome escape peptides are attached along the length of siRNAs.

In some embodiments, a molecule (e.g., a therapeutic molecule) is a molecule as illustrated[:] in FIG. 1B, by the molecule labeled "D-B1-A-B2-D".

In some embodiments, a molecule (e.g., a therapeutic molecule) is a molecule as illustrated[:] in FIG. 1B, by the molecule labeled "(D)$_n$-B1-A-B2-(D)$_n$" wherein a plurality of Endosome escape peptides are attached to the ends of the siRNAs.

In some embodiments, a molecule (e.g., a therapeutic molecule) is a molecule as illustrated[:] in FIG. 1C, by the molecule labeled "A-B1-D/B2-D".

In some embodiments, a molecule (e.g., a therapeutic molecule) is a molecule as illustrated[:] in FIG. 1C, by the molecule labeled "A-B1-(D)$_n$/B2-(D)$_n$".

In some embodiments, a molecule (e.g., a therapeutic molecule) is a molecule as illustrated[:] in FIG. 1C, by the molecule labeled "A-B1-(D)$_n$-C/B2-(D)$_n$-C".

In some embodiments, a molecule (e.g., a therapeutic molecule) is a molecule as illustrated[:] in FIG. 1C, by the molecule labeled "(D)$_n$-B1/(D)$_n$-B2-A-B1-(D)$_n$/B2-(D)$_n$".

The antibody as described above and illustrated in FIG. 1A-1C, is for representation purposes only and encompasses a humanized antibody or binding fragment thereof, chimeric antibody or binding fragment thereof, monoclonal antibody or binding fragment thereof, monovalent Fab', divalent Fab2, single-chain variable fragment (scFv), diabody, minibody, nanobody, single-domain antibody (sdAb), or camelid antibody or binding fragment thereof.

Polynucleic Acid Molecule Targets

In some embodiments, the polynucleic acid molecule B is a polynucleic acid molecule (or polynucleotide) that hybridizes to a target region on an oncogene. In some instances, oncogenes are further classified into several categories: growth factors or mitogens, receptor tyrosine kinases, cytoplasmic tyrosine kinases, cytoplasmic serine/threonine kinases, regulatory GTPases, and transcription factors. Exemplary growth factors include c-Sis. Exemplary receptor tyrosine kinases include epidermal growth factor receptor (EGFR), platelet-derived growth factor receptor (PDGFR), vascular endothelial growth factor receptor (VEGFR), and HER2/neu. Exemplary cytoplasmic tyrosine kinases include Src-family tyrosine kinases, Syk-ZAP-70 family of tyrosine kinases, BTK family of tyrosine kinases, and Abl gene in CML. Exemplary cytoplasmic serine/threonine kinases include Raf kinase and cyclin-dependent kinases. Exemplary regulatory GTPases include Ras family of proteins such as KRAS. Exemplary transcription factors include MYC gene. In some instances, an oncogene described herein comprises an oncogene selected from growth factors or mitogens, receptor tyrosine kinases, cytoplasmic tyrosine kinases, cytoplasmic serine/threonine kinases, regulatory GTPases, or transcription factors. In some embodiments, the polynucleic acid molecule is a polynucleic acid molecule that hybridizes to a target region of an oncogene selected from growth factors or mitogens, receptor tyrosine kinases, cytoplasmic tyrosine kinases, cytoplasmic serine/threonine kinases, regulatory GTPases, or transcription factors.

In some embodiments, an oncogene described herein comprises Abl, AKT-2, ALK, AML1 (or RUNX1), AR, AXL, BCL-2, 3, 6, BRA F, c-MYC, EGFR, ErbB-2 (Her2, Neu), Fms, FOS, GLI1, HPRT1, IL-3, INTS2, JUN, KIT, KS3, K-sam, LBC (AKAP13), LCK, LMO1, LMO2, LYL1, MAS1, MDM2, MET, MLL (KMT2A), MOS, MYB, MYH11/CBFB, NOTCH1 (TAN1), NTRK1 (TRK), OST (SLC51B), PAX5, PIM1, PRAD-1, RAF, RAR/PML, HRAS, KRAS, NRAS, REL/NRG, RET, ROS, SKI, SRC, TIAM1, or TSC2. In some embodiments, the polynucleic acid molecule is a polynucleic acid molecule that hybridizes to a target region of Abl, AKT-2, ALK, AML1 (or RUNX1), AR, AXL, BCL-2, 3, 6, BRAF, c-MYC, EGFR, ErbB-2 (Her2, Neu), Fms, FOS, GLI1, HPRT1, IL-3, INTS2, JUN, KIT, KS3, K-sam, LBC (AKAP13), LCK, LMO1, LMO2, LYL1, MAS1, MDM2, MET, MLL (KMT2A), MOS, MYB, MYH11/CBFB, NOTCH1 (TAN1), NTRK1 (TRK), OST (SLC51B), PAX5, PIM1, PRAD-1, RAF, RAR/PML, HRAS, KRAS, NRAS, REL/NRG, RET, ROS, SKI, SRC, TIAM1, or TSC2.

In some embodiments, an oncogene described herein comprises KRAS, EGFR, AR, HPRT1, CNNTB1 (β-catenin), or β-catenin associated genes. In some embodiments, the polynucleic acid molecule B is a polynucleic acid molecule that hybridizes to a target region of KRAS, EGFR, AR, HPRT1, CNNTB1 (β-catenin), or β-catenin associated genes. In some embodiments, the polynucleic acid molecule B is a polynucleic acid molecule that hybridizes to a target region of KRAS. In some embodiments, the polynucleic acid molecule B is a polynucleic acid molecule that hybridizes to a target region of EGFR. In some embodiments, the polynucleic acid molecule B is a polynucleic acid molecule that hybridizes to a target region of AR. In some embodiments, the polynucleic acid molecule B is a polynucleic acid molecule that hybridizes to a target region of CNNTB1 (β-catenin). In some embodiments, the polynucleic acid molecule B is a polynucleic acid molecule that hybridizes to a target region of CNNTB1 (β-catenin) associated genes. In some instances, the β-catenin associated genes comprise PIK3CA, PIK3CB, and Myc. In some instances, the polynucleic acid molecule B is a polynucleic acid molecule that hybridizes to a target region of HPRT1.

Polynucleic Acid Molecules that Target Kirsten Rat Sarcoma Viral Oncogene Homolog (KRAS)

Kirsten Rat Sarcoma Viral Oncogene Homolog (also known as GTPase KRas, V-Ki-ras2 Kirsten rat sarcoma viral oncogene homolog, or KRAS) is involved in regulating cell division. The K-Ras protein is a GTPase belonging to the Ras superfamily. In some instances, K-Ras modulates cell cycle progression, as well as induces growth arrest, apoptosis, and replicative senescence under different environmental triggers (e.g., cellular stress, ultraviolet, heat shock, or ionizing irradiation). In some cases, wild type KRAS gene has been shown to be frequently lost during tumor progression in different types of cancer, while mutations of KRAS gene have been linked to cancer development. In some instances, KRAS amplification has also been implicated in cancer development (see, for example, Valtorta et al. "KRAS gene amplification in colorectal cancer and impact on response to EGFR-targeted therapy," *Int. J. Cancer* 133: 1259-1266 (2013)). In such cases, the cancer pertains to a refractory cancer in which the patient has acquired resistance to a particular inhibitor or class of inhibitors.

In some embodiments, the KRAS gene is wild type or comprises a mutation. In some instances, KRAS mRNA is wild type or comprises a mutation. In some instances, the polynucleic acid molecule is a polynucleic acid molecule that hybridizes to a target region of wild type KRAS DNA or RNA. In some instances, the polynucleic acid molecule is a polynucleic acid molecule that hybridizes to a target region of KRAS DNA or RNA comprising a mutation (e.g., a substitution, a deletion, or an addition).

In some embodiments, KRAS DNA or RNA comprises one or more mutations. In some embodiments, KRAS DNA or RNA comprises one or more mutations at codons 12 or 13 in exon 1. In some instances, KRAS DNA or RNA comprises one or more mutations at codons 61, 63, 117, 119, or 146. In some instances, KRAS DNA or RNA comprises one or more mutations at positions corresponding to amino acid residues 12, 13, 18, 19, 20, 22, 24, 26, 36, 59, 61, 63, 64, 68, 110, 116, 117, 119, 146, 147, 158, 164, 176, or a combination thereof of the KRAS polypeptide. In some embodiments, KRAS DNA or RNA comprises one or more mutations at positions corresponding to amino acid residues selected from G12V, G12D, G12C, G12A, G12S, G12F, G13C, G13D, G13V, A18D, L19F, T20R, Q22K, I24N, N26K, I36L, I36M, A59G, A59E, Q61K, Q61H, Q61L, Q61R, E63K, Y64D, Y64N, R68S, P110S, K117N, C118S, A146T, A146P, A146V, K147N, T158A, R164Q, K176Q, or a combination thereof of the KRAS polypeptide.

In some embodiments, the polynucleic acid molecule hybridizes to a target region of KRAS DNA or RNA comprising one or more mutations. In some embodiments, the polynucleic acid molecule hybridizes to a target region of KRAS DNA or RNA comprising one or more mutations at codons 12 or 13 in exon 1. In some embodiments, the polynucleic acid molecule hybridizes to a target region of KRAS DNA or RNA comprising one or more mutations at codons 61, 63, 117, 119, or 146. In some embodiments, the polynucleic acid molecule hybridizes to a target region of KRAS DNA or RNA comprising one or more mutations at positions corresponding to amino acid residues 12, 13, 18, 19, 20, 22, 24, 26, 36, 59, 61, 63, 64, 68, 110, 116, 117, 119, 146, 147, 158, 164, 176, or a combination thereof of the KRAS polypeptide. In some embodiments, the polynucleic acid molecule hybridizes to a target region of KRAS DNA or RNA comprising one or more mutations corresponding to amino acid residues selected from G12V, G12D, G12C, G12A, G12S, G12F, G13C, G13D, G13V, A18D, L19F, T20R, Q22K, I24N, N26K, I36L, I36M, A59G, A59E, Q61K, Q61H, Q61L, Q61R, E63K, Y64D, Y64N, R68S, P110S, K117N, C118S, A146T, A146P, A146V, K147N, T158A, R164Q, K176Q, or a combination thereof of the KRAS polypeptide.

Polynucleic Acid Molecules that Target Epidermal Growth Factor Receptor (EGFR)

Epidermal growth factor receptor (EGFR, ErbB-1, or HER1) is a transmembrane tyrosine kinase receptor and a member of the ErbB family of receptors, which also include HER2/c-neu (ErbB-2), Her3 (ErbB-3) and Her4 (ErbB-4). In some instances, EGFR mutations drive the downstream activation of RAS/RAF/MAPK, PI3K/AKT, and/or JAK/STAT pathways, leading to mitosis, cell proliferation, and suppression of apoptosis. In addition, amplification of wild-type EGFR gene has been implicated in the development of cancers such as glioblastomas and non-small cell lung cancer (Talasila, et al., "EGFR Wild-type Amplification and Activation Promote Invasion and Development of Glioblastoma Independent of Angiogenesis," Acta Neuropathol. 125 (5): 683-698 (2013); Bell et al., "Epidermal Growth Factor Receptor Mutations and Gene Amplification in Non-Small-Cell Lung Cancer: Molecular Analysis of the IDEAL/INTACT Gefitinib Trials," *J. Clinical Oncology* 23(31): 8081-8092 (2005)).

In some embodiments, EGFR DNA or RNA is wild type EGFR or EGFR comprising a mutation. In some instances, EGFR is wild type EGFR. In some instances, EGFR DNA or RNA comprises a mutation. In some instances, the polynucleic acid molecule hybridizes to a target region of wild type EGFR DNA or RNA. In some instances, the polynucleic acid molecule hybridizes to a target region of EGFR DNA or RNA comprising a mutation (e.g., a substitution, a deletion, or an addition).

In some instances, EGFR DNA or RNA comprises one or more mutations. In some embodiments, EGFR DNA or RNA comprises one or more mutations within one or more exons. In some instances, the one or more exons comprise exon 18, exon 19, exon 20, exon 21 or exon 22. In some instances, EGFR DNA or RNA comprises one or more mutations in exon 18, exon 19, exon 20, exon 21, exon 22 or a combination thereof.

In some instances, EGFR DNA or RNA comprises one or more mutations at positions corresponding to amino acid residues 34, 38, 45, 62, 63, 77, 78, 108, 114, 120, 140, 148, 149, 160, 177, 178, 189, 191, 198, 220, 222, 223, 229, 237, 240, 244, 252, 254, 255, 256, 263, 270, 273, 276, 282, 288, 289, 301, 303, 304, 309, 314, 326, 331, 354, 363, 373, 337, 380, 384, 393, 427, 428, 437, 441, 447, 465, 475, 515, 526, 527, 531, 536, 541, 546, 571, 588, 589, 596, 596, 598, 602, 614, 620, 628, 636, 641, 645, 651, 671, 689, 694, 700, 709, 712, 714, 715, 716, 719, 720, 721, 731, 733, 739-744, 742, 746-750, 746-752, 746, 747, 747-749, 747-751, 747-753, 751, 752, 754, 752-759, 750, 761-762, 761, 763, 765, 767-768, 767-769, 768, 769, 769-770, 770-771, 772, 773-774, 773, 774, 774-775, 776, 779, 783, 784, 786, 790, 792, 794, 798, 803, 805, 807, 810, 826, 827, 831, 832, 833, 835, 837, 838, 839, 842, 843, 847, 850, 851, 853, 854, 856, 858, 861, 863, 894, 917, 967, 1006, 1019, 1042, 1100, 1129, 1141, 1153, 1164, 1167, or a combination thereof of the EGFR polypeptide. In some embodiments, EGFR DNA or RNA comprises one or more mutations at positions corresponding to amino acid residues 747, 761, 790, 854, 858, or a combination thereof of the EGFR polypeptide. In some embodiments, EGFR DNA or RNA comprises one or more mutations at positions corresponding to amino acid residues 761, 790, 858, or a combination thereof of the EGFR polypeptide. In some embodiments, EGFR DNA or RNA comprises a mutation at a position corresponding to amino acid residue 747 of the EGFR polypeptide. In some embodiments, EGFR DNA or RNA comprises a mutation at a position corresponding to amino acid residue 761 of the EGFR polypeptide. In some embodiments, EGFR DNA or RNA comprises a mutation at a position corresponding to amino acid residue 790 of the EGFR polypeptide. In some embodiments, EGFR DNA or RNA comprises a mutation at a position corresponding to amino acid residue 854 of the EGFR polypeptide. In some embodiments, EGFR DNA or RNA comprises a mutation at a position corresponding to amino acid residue 858 of the EGFR polypeptide.

In some embodiments, EGFR DNA or RNA comprises one or more mutations selected from T34M, L38V, E45Q, L62R, G63R, G63K, S77F, F78L, R108K, R108G, E114K, A120P, L140V, V148M, R149W, E160K, S177P, M178I, K189T, D191N, S198R, S220P, R222L, R222C, S223Y, S229C, A237Y, C240Y, R244G, R252C, R252P, F254I, R255 (nonsense mutation), D256Y, T263P, Y270C, T273A, Q276 (nonsense), E282K, G288 (frame shift), A289D, A289V, A289T, A289N, A289D, V301 (deletion), D303H, H304Y, R309Q, D314N, C326R, G331R, T354M, T363I, P373Q, R337S, S380 (frame shift), T384S, D393Y, R427L, G428S, S437Y, V441I, S447Y, G465R, I475V, C515S, C526S, R527L, R531 (nonsense), V536M, L541I, P546Q, C571S, G588S, P589L, P596L, P596S, P596R, P596L, G598V, G598A, E602G, G614D, C620Y, C620W, C628Y, C628F, C636Y, T638M, P641H, S645C, V651M, R671C, V689M, P694S, N700D, E709A, E709K, E709Q, E709K, F712L, K714N, I715S, K716R, G719A, G719C, G719D, G719S, S720C, S720F, G721V, W731Stop, P733L, K739-I744 (insertion), V742I, V742A, E746-A750 (deletion), E746K, L747S, L747-E749 (deletion), L747-T751 (deletion), L747-P753 (deletion), G746-S752 (deletion), T751I, S752Y, K754 (deletion), S752-I759 (deletion), A750P, D761-E762 (e.g., residues EAFQ insertion (SEQ ID NO: 2110)), D761N, D761Y, A763V, V765A, A767-S768 (e.g., residues TLA insertion), A767-V769 (e.g., residues ASV insertion), S768I, S768T, V769L, V769M, V769-D770 (e.g., residue Y insertion), 770-771 (e.g., residues GL insertion), 770-771 (e.g., residue G insertion), 770-771 (e.g., residues CV insertion), 770-771 (e.g., residues SVD insertion), P772R, 773-774 (e.g., residues NPH insertion), H773R, H773L, V774M, 774-775 (e.g., residues HV insertion), R776H, R776C, G779F, T783A, T784F, T854A, V786L, T790M, L792P, P794H, L798F, R803W, H805R, D807H, G810S, N826S, Y827 (nonsense), R831H, R832C, R832H, L833F, L833V, H835L, D837V, L838M, L838P, A839V, N842H, V843L, T847K, T847I, H850N, V851A, I853T, F856L, L858R, L858M, L861Q, L861R, G863D, Q894L, G917A, E967A, D1006Y, P1019L, S1042N, R1100S, H1129Y, T1141S, S1153I, Q1164R, L1167M, or a combination thereof of the EGFR polypeptide.

In some instances, the polynucleic acid molecule hybridizes to a target region of EGFR DNA or RNA comprising one or more mutations. In some embodiments, the polynucleic acid molecule hybridizes to a target region of EGFR DNA or RNA comprising one or more mutations in exon 18, exon 19, exon 20, exon 21, exon 22 or a combination thereof.

In some embodiments, the polynucleic acid molecule hybridizes to a target region of EGFR DNA or RNA comprising one or more mutations at positions corresponding to amino acid residues 34, 38, 45, 62, 63, 77, 78, 108, 114, 120, 140, 148, 149, 160, 177, 178, 189, 191, 198, 220, 222, 223, 229, 237, 240, 244, 252, 254, 255, 256, 263, 270, 273, 276, 282, 288, 289, 301, 303, 304, 309, 314, 326, 331, 354, 363, 373, 337, 380, 384, 393, 427, 428, 437, 441, 447, 465, 475, 515, 526, 527, 531, 536, 541, 546, 571, 588, 589, 596, 596, 598, 602, 614, 620, 628, 636, 641, 645, 651, 671, 689, 694, 700, 709, 712, 714, 715, 716, 719, 720, 721, 731, 733, 739-744, 742, 746-750, 746-752, 746, 747, 747-749, 747-751, 747-753, 751, 752, 754, 752-759, 750, 761-762, 761, 763, 765, 767-768, 767-769, 768, 769, 769-770, 770-771, 772, 773-774, 773, 774, 774-775, 776, 779, 783, 784, 786, 790, 792, 794, 798, 803, 805, 807, 810, 826, 827, 831, 832, 833, 835, 837, 838, 839, 842, 843, 847, 850, 851, 853, 854, 856, 858, 861, 863, 894, 917, 967, 1006, 1019, 1042, 1100, 1129, 1141, 1153, 1164, 1167, or a combination thereof of the EGFR polypeptide. In some embodiments, the polynucleic acid molecule hybridizes to a target region of EGFR DNA or RNA comprising one or more mutations at positions corresponding to amino acid residues 747, 761, 790, 854, 858, or a combination thereof of the EGFR polypeptide. In some embodiments, the polynucleic acid molecule hybridizes to a target region of EGFR DNA or RNA comprising one or more mutations at positions corresponding to amino acid residues 761, 790, 858, or a combination thereof of the EGFR polypeptide. In some embodiments, the polynucleic acid molecule hybridizes to a target region of EGFR DNA or RNA comprising a mutation at a position corresponding to amino acid residue 747 of the EGFR polypeptide. In some embodiments, the polynucleic acid molecule hybridizes to a target region of EGFR DNA or RNA comprising a mutation at a position corresponding to amino acid residue 761 of the EGFR polypeptide. In some embodiments, the polynucleic acid molecule hybridizes to a target region of EGFR DNA or RNA comprising a mutation at a position corresponding to amino acid residue 790 of the EGFR polypeptide. In some embodiments, the polynucleic acid molecule hybridizes to a target region of EGFR DNA or RNA comprising a mutation at a position corresponding to amino acid residue 854 of the EGFR polypeptide. In some embodiments, the polynucleic acid molecule hybridizes to a target region of EGFR DNA or RNA comprising a mutation at a position corresponding to amino acid residue 858 of the EGFR polypeptide.

In some embodiments, the polynucleic acid molecule hybridizes to a target region of EGFR DNA or RNA comprising one or more mutations selected from T34M, L38V, E45Q, L62R, G63R, G63K, S77F, F78L, R108K, R108G, E114K, A120P, L140V, V148M, R149W, E160K, S177P, M178I, K189T, D191N, S198R, S220P, R222L, R222C, S223Y, S229C, A237Y, C240Y, R244G, R252C, R252P, F254I, R255 (nonsense mutation), D256Y, T263P, Y270C, T273A, Q276 (nonsense), E282K, G288 (frame shift), A289D, A289V, A289T, A289N, A289D, V301 (deletion), D303H, H304Y, R309Q, D314N, C326R, G331R, T354M, T363I, P373Q, R337S, S380 (frame shift), T384S, D393Y, R427L, G428S, S437Y, V441I, S447Y, G465R, I475V, C515S, C526S, R527L, R531 (nonsense), V536M, L541I, P546Q, C571S, G588S, P589L, P596L, P596S, P596R, P596L, G598V, G598A, E602G, G614D, C620Y, C620W, C628Y, C628F, C636Y, T638M, P641H, S645C, V651M, R671C, V689M, P694S, N700D, E709A, E709K, E709Q, E709K, F712L, K714N, I715S, K716R, G719A, G719C, G719D, G719S, S720C, S720F, G721V, W731Stop, P733L, K739-I744 (insertion), V742I, V742A, E746-A750 (deletion), E746K, L747S, L747-E749 (deletion), L747-T751 (deletion), L747-P753 (deletion), G746-S752 (deletion), T751I, S752Y, K754 (deletion), S752-I759 (deletion), A750P, D761-E762 (e.g., residues EAFQ insertion (SEQ ID NO: 2110)), D761N, D761Y, A763V, V765A, A767-S768 (e.g., residues TLA insertion), A767-V769 (e.g., residues ASV insertion), S768I, S768T, V769L, V769M, V769-D770 (e.g., residue Y insertion), 770-771 (e.g., residues GL insertion), 770-771 (e.g., residue G insertion), 770-771 (e.g., residues CV insertion), 770-771 (e.g., residues SVD insertion), P772R, 773-774 (e.g., residues NPH insertion), H773R, H773L, V774M, 774-775 (e.g., residues HV insertion), R776H, R776C, G779F, T783A, T784F, T854A, V786L, T790M, L792P, P794H, L798F, R803W, H805R, D807H, G810S, N826S, Y827 (nonsense), R831H, R832C, R832H, L833F, L833V, H835L, D837V, L838M, L838P, A839V, N842H, V843L, T847K, T847I, H850N, V851A, I853T, F856L, L858R, L858M, L861Q, L861R, G863D, Q894L, G917A, E967A, D1006Y, P1019L, S1042N, R1100S, H1129Y, T1141S, S1153I, Q1164R, L1167M, or a combination thereof of the EGFR polypeptide. In some embodiments, the polynucleic acid molecule hybridizes to a target region of EGFR DNA or RNA comprising one or more mutations selected from L747S, D761Y, T790M, T854A, L858R, or a combination thereof of the EGFR polypeptide. In some embodiments, the polynucleic acid molecule hybridizes to a target region of EGFR DNA or RNA comprising one or more mutations selected from D761Y, T790M, L858R, or a combination thereof of the EGFR polypeptide. In some embodiments, the polynucleic acid molecule hybridizes to a target region of EGFR DNA or RNA comprising mutation L747S of the EGFR polypeptide. In some embodiments, the polynucleic acid molecule hybridizes to a target region of EGFR DNA or RNA comprising mutation D761Y of the EGFR polypeptide. In some embodiments, the polynucleic acid molecule hybridizes to a target region of EGFR DNA or RNA comprising mutation T790M of the EGFR polypeptide. In some embodiments, the polynucleic acid molecule hybridizes to a target region of EGFR DNA or RNA comprising mutation T854A of the EGFR polypeptide. In some embodiments, the polynucleic acid molecule hybridizes to a target region of EGFR DNA or RNA comprising mutation L858R of the EGFR polypeptide.

Polynucleic Acid Molecules that Target Androgen Receptor (AR)

Androgen receptor (AR) (also known as NR3C4, nuclear receptor subfamily 3, group C, gene 4) belongs to the steroid hormone group of nuclear receptor superfamily along with related members: estrogen receptor (ER), glucocorticoid receptor (GR), progesterone receptor (PR), and mineralocorticoid receptor (MR). Androgens, or steroid hormones, modulate protein synthesis and tissue remodeling through the androgen receptor. The AR protein is a ligand-inducible zinc finger transcription factor that regulates target gene expression. The presence of mutations in the AR gene has been observed in several types of cancers (e.g., prostate cancer, breast cancer, bladder cancer, or esophageal cancer), and in some instances, has been linked to metastatic progression.

In some embodiments, AR DNA or RNA is wild type or comprises one or more mutations and/or splice variants. In some instances, AR DNA or RNA comprises one or more mutations. In some instances, AR DNA or RNA comprises one or more splice variants selected from AR splice variants including but not limited to AR1/2/2b, ARV2, ARV3, ARV4, AR1/2/3/2b, ARV5, ARV6, ARV7, ARV9, ARV10, ARV11, ARV12, ARV13, ARV14, ARV15, ARV16, and ARV (v567es). In some instances, the polynucleic acid molecule hybridizes to a target region of AR DNA or RNA comprising a mutation (e.g., a substitution, a deletion, or an addition) or a splice variant.

In some embodiments, AR DNA or RNA comprises one or more mutations. In some embodiments, AR DNA or RNA comprises one or more mutations within one or more exons. In some instances, the one or more exons comprise exon 1, exon 2, exon 3, exon 4, exon 5, exon 6, exon 7, or exon 8. In some embodiments, AR DNA or RNA comprises one or more mutations within exon 1, exon 2, exon 3, exon 4, exon 5, exon 6, exon 7, exon 8 or a combination thereof. In some instances, AR DNA or RNA comprises one or more mutations at positions corresponding to amino acid residues 2, 14, 16, 29, 45, 54, 57, 64, 106, 112, 176, 180, 184, 194, 198, 204, 214, 221, 222, 233, 243, 252, 255, 266, 269, 287, 288, 334, 335, 340, 363, 368, 369, 390, 403, 443, 491, 505, 513, 524, 524, 528, 533, 547, 548, 564, 567, 568, 574, 547, 559, 568, 571, 573, 575, 576, 577, 578, 579, 580, 581, 582, 585, 586, 587, 596, 597, 599, 601, 604, 607, 608, 609, 610, 611, 615, 616, 617, 619, 622, 629, 630, 638, 645, 647, 653, 662, 664, 670, 671, 672, 674, 677, 681, 682, 683, 684, 687, 688, 689, 690, 695, 700, 701, 702, 703, 705, 706, 707, 708, 710, 711, 712, 715, 717, 720, 721, 722, 723, 724, 725, 726, 727, 728, 730, 732, 733, 737, 739, 741, 742, 743, 744, 745, 746, 748, 749, 750, 751, 752, 754, 755, 756, 757, 758, 759, 762, 763, 764, 765, 766, 767, 768, 771, 772, 774, 777, 779, 786, 795, 780, 782, 784, 787, 788, 790, 791, 793, 794, 798, 802, 803, 804, 806, 807, 812, 813, 814, 819, 820, 821, 824, 827, 828, 830, 831, 834, 840, 841, 842, 846, 854, 855, 856, 863, 864, 866, 869, 870, 871, 874, 875, 877, 879, 880, 881, 886, 888, 889, 891, 892, 895, 896, 897, 898, 902, 903, 904, 907, 909, 910, 911, 913, 916, 919, or a combination thereof of the AR polypeptide. In some embodiments, AR DNA or RNA comprises one or more mutations at positions corresponding to amino acid residues selected from E2K, P14Q, K16N, V29M, S45T, L54S, L57Q, Q64R, Y106C, Q112H, S176S, K180R, L184P, Q194R, E198G, G204S, G214R, K221N, N222D, D233K, S243L, A252V, L255P, M266T, P269S, A287D, E288K, S334P, S335T, P340L, Y363N, L368V, A369P, P390R, P390S, P390L, A403V, Q443R, G491S, G505D, P513S, G524D, G524S, D528G, P533S, L547F, P548S, D564Y, S567F, G568W, L574P, L547F, C559Y, G568W, G568V, Y571C, Y571H, A573D, T575A, C576R, C576F, G577R, S578T, C579Y, C579F, K580R, V581F, F582Y, F582S, R585K, A586V, A587S, A596T, A596S, S597G, S597I, N599Y, C601F, D604Y, R607Q, R608K, K609N, D610T, C611Y, R615H, R615P, R615G, R616C, L616R, L616P, R617P, C619Y, A622V, R629W, R629Q, K630T, L638M, A645D, S647N, E653K, S662 (nonsense), I664N, Q670L, Q670R, P671H, I672T, L674P, L677P, E681L, P682T, G683A, V684I, V684A, A687V, G688Q, H689P, D690V, D695N, D695V, D695H, L700M, L701P, L7011, H701H, S702A, S703G, N705S, N705Y, E706 (nonsense), L707R, G708A, R710T, Q711E, L712F, V715M, K717Q, K720E, A721T, L722F, P723S, G724S, G724D, G724N, F725L, R726L, N727K, L728S, L728I, V730M, D732N, D732Y, D732E, Q733H, I737T, Y739D, W741R, M742V, M742I, G743R, G743V, L744F, M745T, V746M, A748D, A748V, A748T, M749V, M749I, G750S, G750D, W751R, R752Q, F754V, F754L, T755A, N756S, N756D, V757A, N758T, S759F, S759P, L762F, Y763H, Y763C, F764L, A765T, A765V, P766A, P766S, D767E, L768P, L768M, N771H, E772G, E772A, R774H, R774C, K777T, R779W, R786Q, G795V, M7801, S782N, C784Y, M787V, R788S, L790F, S791P, E793D, F794S, Q798E, Q802R, G803L, F804L, C806Y, M807V, M807R, M8071, L812P, F813V, S814N, N819Q, G820A, L821V, Q824L, Q824R, F827L, F827V, D828H, L830V, L830P, R831 Q, R831L, Y834C, R840C, R840H, I841S, I842T, R846G, R854K, R855C, R855H, F856L, L863R, D864N, D864E, D864G, V866L, V866M, V866E, I869M, A870G, A870V, R871G, H874Y, H874R, Q875K, T877S, T877A, D879T, D879G, L880Q, L881V, M886V, S888L, V889M, F891L, P892L, M895T, A896T, E897D, I8981, Q902R, V903M, P904S, P904H, L907F, G909R, G909E, K910R, V911L, P913S, F916L, Q919R, or a combination thereof of the AR polypeptide.

In some embodiments, the polynucleic acid molecule hybridizes to a target region of AR DNA or RNA comprising one or more mutations. In some embodiments the polynucleic acid hybridizes to one or more AR splice variants. In some embodiments the polynucleic acid hybridizes to AR DNA or RNA comprising one or more AR splice variants including but not limited to AR1/2/2b, ARV2, ARV3, ARV4, AR1/2/3/2b, ARV5, ARV6, ARV7, ARV9, ARV10, ARV11, ARV12, ARV13, ARV14, ARV15, ARV16, and ARV (v567es). In some embodiments, the polynucleic acid molecule hybridizes to a target region of AR DNA or RNA comprising one or more mutations within exon 1, exon 2, exon 3, exon 4, exon 5, exon 6, exon 7, exon 8 or a combination thereof. In some embodiments, the polynucleic acid molecule hybridizes to a target region of AR DNA or RNA comprising one or more mutations at positions corresponding to amino acid residues 2, 14, 16, 29, 45, 54, 57, 64, 106, 112, 176, 180, 184, 194, 198, 204, 214, 221, 222, 233, 243, 252, 255, 266, 269, 287, 288, 334, 335, 340, 363, 368, 369, 390, 403, 443, 491, 505, 513, 524, 524, 528, 533, 547, 548, 564, 567, 568, 574, 547, 559, 568, 571, 573, 575, 576, 577, 578, 579, 580, 581, 582, 585, 586, 587, 596, 597, 599, 601, 604, 607, 608, 609, 610, 611, 615, 616, 617, 619, 622, 629, 630, 638, 645, 647, 653, 662, 664, 670, 671, 672, 674, 677, 681, 682, 683, 684, 687, 688, 689, 690, 695, 700, 701, 702, 703, 705, 706, 707, 708, 710, 711, 712, 715, 717, 720, 721, 722, 723, 724, 725, 726, 727, 728, 730, 732, 733, 737, 739, 741, 742, 743, 744, 745, 746, 748, 749, 750, 751, 752, 754, 755, 756, 757, 758, 759, 762, 763, 764, 765, 766, 767, 768, 771, 772, 774, 777, 779, 786, 795, 780, 782, 784, 787, 788, 790, 791, 793, 794, 798, 802, 803, 804, 806, 807, 812, 813, 814, 819, 820, 821, 824, 827, 828, 830, 831, 834, 840, 841, 842, 846, 854, 855, 856, 863, 864, 866, 869, 870, 871, 874, 875, 877, 879, 880, 881, 886, 888, 889, 891, 892, 895, 896, 897, 898, 902, 903, 904, 907, 909, 910, 911, 913, 916, 919, or a combination thereof of the AR polypeptide. In some embodiments, the polynucleic acid molecule hybridizes to a target region of AR DNA or RNA comprising one or more mutations selected from E2K, P14Q, K16N, V29M, S45T, L54S, L57Q, Q64R, Y106Q, Q112H, S176S, K180R, L184P, Q194R, E198G, G204S, G214R, K221N, N222D, D233K, S243L, A252V, L255P, M266T, P269S, A287D, E288K, S334P, S335T, P340L, Y363N, L368V, A369P, P390R, P390S, P390L, A403V, Q443R, G491S, G505D, P513S, G524D, G524S, D528G, P533S, L547F, P548S, D564Y, S567F, G568W, L574P, L547F, C559Y, G568W, G568V, Y571C, Y571H, A573D, T575A, C576R, C576F, G577R, S578T, C579Y, C579F, K580R, V581F, F582Y, F582S, R585K, A586V, A587S, A596T, A596S, S597G, S597I, N599Y, C601F, D604Y, R607Q, R608K, K609N, D610T, C611Y, R615H, R615P, R615G, R616C, L616R, L616P, R617P, C619Y, A622V, R629W, R629Q, K630T, L638M, A645D, S647N, E653K, S662 (nonsense), I664N, Q670L, Q670R, P671H, I672T, L674P, L677P, E681L, P682T, G683A, V684I, V684A, A687V, G688Q, H689P, D690V, D695N, D695V, D695H, L700M, L701P, L701I, H701H, S702A, S703G, N705S, N705Y, E706 (nonsense), L707R, G708A, R710T, Q711E, L712F, V715M, K717Q, K720E, A721T, L722F, P723S, G724S, G724D, G724N, F725L, R726L, N727K, L728S, L728I, V730M, D732N, D732Y, D732E, Q733H, I737T, Y739D, W741R, M742V, M742I, G743R, G743V, L744F, M745T, V746M, A748D, A748V, A748T, M749V, M749I, G750S, G750D, W751R, R752Q, F754V, F754L, T755A, N756S, N756D, V757A, N758T, S759F, S759P, L762F, Y763H, Y763C, F764L, A765T, A765V, P766A, P766S, D767E, L768P, L768M, N771H, E772G, E772A, R774H, R774C, K777T, R779W, R786Q, G795V, M780I, S782N, C784Y, M787V, R788S, L790F, S791P, E793D, F794S, Q798E, Q802R, G803L, F804L, C806Y, M807V, M807R, M807I, L812P, F813V, S814N, N819Q, G820A, L821V, Q824L, Q824R, F827L, F827V, D828H, L830V, L830P, R831Q, R831L, Y834C, R840C, R840H, I841 S, I842T, R846G, R854K, R855C, R855H, F856L, L863R, D864N, D864E, D864G, V866L, V866M, V866E, I869M, A870G, A870V, R87G, H874Y, H874R, Q875K, T877S, T877A, D879T, D879G, L880Q, L881V, M886V, S888L, V889M, F891L, P892L, M895T, A896T, E897D, I898T, Q902R, V903M, P904S, P904H, L907F, G909R, G909E, K910R, V911L, P913S, F916L, Q919R, or a combination thereof of the AR polypeptide.

Polynucleic Acid Molecules that Target B-Catenin and B-Catenin-Associated Genes

Catenin beta-1 (also known as CTNNB1, β-catenin, or beta-catenin) is a member of the catenin protein family. In humans, it is encoded by the CTNNB1 gene and is known for its dual functions—cell-cell adhesion and gene transcription. Beta-catenin is an integral structural component of cadherin-based adherens junctions and regulates cell growth and adhesion between cells and anchors the actin cytoskeleton. In some instance, beta-catenin is responsible for transmitting the contact inhibition signal that causes the cells to stop dividing once the epithelial sheet is complete. Beta-catenin is also a key nuclear effector of the Wnt signaling pathway. In some instances, imbalance in the structural and signaling properties of beta-catenin results in diseases and deregulated growth connected to malignancies such as cancer. For example, overexpression of beta-catenin has been linked to cancers such as gastric cancer (Suriano, et al., "Beta-catenin (CTNNB1) gene amplification: a new mechanism of protein overexpression in cancer," Genes Chromosomes Cancer 42(3): 238-246 (2005)). In some cases, mutations in CTNNB1 gene have been linked to cancer development (e.g., colon cancer, melanoma, hepatocellular carcinoma, ovarian cancer, endometrial cancer, medulloblastoma pilomatricomas, or prostrate cancer), and in some instances, has been linked to metastatic progression. In additional cases, mutations in the CTNNB1 gene cause beta-catenin to translocate to the nucleus without any external stimulus and drive the transcription of its target genes continuously. In some cases, the potential of beta-catenin to change the previously epithelial phenotype of affected cells into an invasive, mesenchyme-like type contributes to metastasis formation.

In some embodiments, CTNNB1 gene is wild type CTNNB1 or CTNNB1 comprising one or more mutations. In some instances, CTNNB1 is wild type CTNNB1. In some instances, CTNNB1 is CTNNB1 comprising one or more mutations. In some instances, the polynucleic acid molecule is a polynucleic acid molecule that hybridizes to a target region of wild type CTNNB1. In some instances, the polynucleic acid molecule is a polynucleic acid molecule that hybridizes to a target region of CTNNB1 comprising a mutation (e.g., a substitution, a deletion, or an addition).

In some embodiments, CTNNB1 DNA or RNA comprises one or more mutations. In some embodiments, CTNNB1 DNA or RNA comprises one or more mutations within one or more exons. In some instances, the one or more exons comprise exon 3. In some instances, CTNNB1 DNA or RNA comprises one or more mutations at codons 32, 33, 34, 37, 41, 45, 183, 245, 287 or a combination thereof. In some instances, CTNNB1 DNA or RNA comprises one or more mutations at positions corresponding to amino acid residues 25, 31, 32, 33, 34, 35, 36, 37, 41, 45, 140, 162, 170, 199, 213, 215, 257, 303, 322, 334, 354, 367, 373, 383, 387, 402, 426, 453, 474, 486, 515, 517, 535, 553, 555, 582, 587, 619, 623, 641, 646, 688, 703, 710, 712, 714, 724, 738, 777, or a combination thereof of the CTNNB1 polypeptide. In some embodiments, CTNNB1 DNA or RNA comprises one or more mutations at positions corresponding to amino acid residues selected from W25 (nonsense mutation), L31M, D32A, D32N, D32Y, D32G, D32H, S33C, S33Y, S33F, S33P, G34R, G34E, G34V, I35S, H36Y, S37F, S37P, S37C, S37A, T41N, T41A, T41I, S45Y, S45F, S45C, I140T, D162E, K170M, V199I, C213F, A215T, T257I, I303M, Q322K, E334K, K354T, G367V, P373S, W383G, N387K, L402F, N426D, R453L, R453Q, R474 (nonsense mutation), R486C, R515Q, L517F, R535 (nonsense mutation), R535Q, M553V, G555A, R582Q, R587Q, C619Y, Q623E, I641 (frame shift), S646F, M688T, Q703H, R710H, D712N, P714R, Y724H, E738K, F777S, or a combination thereof of the CTNNB1 polypeptide.

In some embodiments, the polynucleic acid molecule hybridizes to a target region of CTNNB1 DNA or RNA comprising one or more mutations. In some embodiments, the polynucleic acid molecule hybridizes to a target region of CTNNB1 DNA or RNA comprising one or more mutations within exon 3. In some embodiments, the polynucleic acid molecule hybridizes to a target region of CTNNB1 DNA or RNA comprising one or more mutations at codons 32, 33, 34, 37, 41, 45, 183, 245, 287 or a combination thereof. In some embodiments, the polynucleic acid molecule hybridizes to a target region of CTNNB1 DNA or RNA comprising one or more mutations at positions corresponding to amino acid residues 25, 31, 32, 33, 34, 35, 36, 37, 41, 45, 140, 162, 170, 199, 213, 215, 257, 303, 322, 334, 354, 367, 373, 383, 387, 402, 426, 453, 474, 486, 515, 517, 535, 553, 555, 582, 587, 619, 623, 641, 646, 688, 703, 710, 712, 714, 724, 738, 777, or a combination thereof of the CTNNB1 polypeptide. In some embodiments, the polynucleic acid molecule hybridizes to a target region of CTNNB1 DNA or RNA comprising one or more mutations selected from W25 (nonsense mutation), L31M, D32A, D32N, D32Y, D32G, D32H, S33C, S33Y, S33F, S33P, G34R, G34E, G34V, I35S, H36Y, S37F, S37P, S37C, S37A, T41N, T41A, T41I, S45Y, S45F, S45C, I140T, D162E, K170M, V199I, C213F, A215T, T257I, I303M, Q322K, E334K, K354T, G367V, P373S, W383G, N387K, L402F, N426D, R453L, R453Q, R474 (nonsense mutation), R486C, R515Q, L517F, 8535 (nonsense mutation), R535Q, M553V, G555A, R582Q, R587Q, C619Y, Q623E, T641 (frame shift), S646F, M688T, Q703H, R710H, D712N, P714R, Y724H, E738K, F777S, or a combination thereof of the CTNNB1 polypeptide.

In some embodiments, beta-catenin associated genes further comprise PIK3CA, PIK3CB, and MYC. In some embodiments, beta-catenin associated genes further comprise PIK3CA DNA or RNA. PIK3CA (phosphatidylinositol-4,5-bisphosphate 3-kinase, catalytic subunit alpha or p110α protein) is a class i PI 3-kinase catalytic subunit that uses ATP to phosphorylate phosphatidylinositols. In some embodiments, PIK3CA gene is wild type PIK3CA or PIK3CA comprising one or more mutations. In some instances, PIK3CA DNA or RNA is wild type PIK3CA. In some instances, PIK3CA DNA or RNA comprises one or more mutations. In some instances, the polynucleic acid molecule hybridizes to a target region of wild type PIK3CA DNA or RNA. In some instances, the polynucleic acid molecule hybridizes to a target region of PIK3CA DNA or RNA comprising a mutation (e.g., a substitution, a deletion, or an addition).

In some embodiments, PIK3CA DNA or RNA comprises one or more mutations. In some embodiments, PIK3CA DNA or RNA comprises one or more mutation within one or more exons. In some instances, PIK3CA DNA or RNA comprises one or more mutation within exons 9 and/or 20. In some instances, PIK3CA DNA or RNA comprises one or more mutations at positions corresponding to amino acid residues 1, 4, 10-16, 11-18, 11, 12, 38, 39, 65, 72, 75, 79, 81, 83, 88, 90, 93, 102, 103, 103-104, 103-106, 104, 105-108, 106, 106-107, 106-108, 107, 108, 109-112, 110, 111, 113, 115, 137, 170, 258, 272, 279, 320, 328, 335, 342, 344, 345, 350, 357, 359, 363, 364, 365, 366, 378, 398, 401, 417, 420, 447-455, 449, 449-457, 451, 453, 454, 455, 455-460, 463-465, 471, 495, 522, 538, 539, 542, 545, 546, 547, 576, 604, 614, 617, 629, 643, 663, 682, 725, 726, 777, 791, 818, 866, 901, 909, 939, 951, 958, 970, 971, 975, 992, 1004, 1007, 1016, 1017, 1021, 1025, 1029, 1037, 1040, 1043, 1044, 1045, 1047, 1048, 1049, 1052, 1065, 1069, or a combination thereof of the PIK3CA polypeptide. In some embodiments, PIK3CA DNA or RNA comprises one or more mutations at positions corresponding to amino acid residues selected from M1V, R4 (nonsense mutation), L10-M16 (deletion), W11-P18 (deletion), W11L, G12D, R38L, R38H, R38C, R38S, E39K, E39G, E65K, S72G, Q75E, R79M, E81K, E81 (deletion), F83Y, R88Q, C90Y, C90G, R93Q, R93W, I102 (deletion), E103G, E103-P104 (deletion), E103-G106 (deletion), P104L, V105-R108 (deletion), G106V, G106-N107 (deletion), G106-R108 (deletion), G106R, N107S, R108L, R108H, E109-I112 (deletion), E110 (deletion), K111E, K111R, K111N, K111 (deletion), L113 (deletion), R115L, Q137L, N170S, D258N, Y272 (nonsense mutation), L279I, G320V, W3285, R335G, T342S, V344G, V344M, V344A, N345K, N345I, N345T, D350N, D350G, R357Q, G359R, G363A, G364R, E365K, E365V, P366R, C378R, C378Y, R398H, R401Q, E417K, C420R, C420G, P447-L455 (deletion), P449L, P449-N457 (deletion), G451R, G451V, E453K, E453Q, E453D, D454Y, L455 (frame shift insertion), L455-G460 (deletion), G463-N465 (deletion), P471L, P471A, H495L, H495Y, E522A, D538N, P539R, E542K, E542V, E542G, E542Q, E542A, E545K, E545A, E545G, E545Q, E545D, Q546K, Q546R, Q546P, E547D, S576Y, C604R, F614I, A617W, S629C, Q643H, I663S, Q682 (deletion), D725N, W726K, R777M, E791Q, R818C, L866W, C901F, F909L, D939G, R951C, Q958R, E970K, C971R, R975S, R992P, M1004I, G1007R, F1016C, D1017H, Y1021H, Y1021C, T1025A, T1025S, D1029H, E1037K, M1040V, M1043V, M1043I, N1044K, N1044Y, D1045V, H1047R, H1047L, H1047Y, H1047Q, H1048R, G1049R, T1052K, H1065L, I069W (nonstop mutation), or a combination thereof of the PIK3CA polypeptide.

In some embodiments, the polynucleic acid molecule hybridizes to a target region of PIK3CA DNA or RNA comprising one or more mutations. In some embodiments, the polynucleic acid molecule hybridizes to a target region of PIK3CA DNA or RNA comprising one or more mutations within an exon. In some embodiments, the polynucleic acid molecule hybridizes to a target region of PIK3CA DNA or RNA comprising one or more mutations within exon 9 or exon 20. In some embodiments, the polynucleic acid molecule hybridizes to a target region of PIK3CA DNA or RNA comprising one or more mutations at positions corresponding to amino acid residues 1, 4, 10-16, 11-18, 11, 12, 38, 39, 65, 72, 75, 79, 81, 83, 88, 90, 93, 102, 103, 103-104, 103-106, 104, 105-108, 106, 106-107, 106-108, 107, 108, 109-112, 110, 111, 113, 115, 137, 170, 258, 272, 279, 320, 328, 335, 342, 344, 345, 350, 357, 359, 363, 364, 365, 366, 378, 398, 401, 417, 420, 447-455, 449, 449-457, 451, 453, 454, 455, 455-460, 463-465, 471, 495, 522, 538, 539, 542, 545, 546, 547, 576, 604, 614, 617, 629, 643, 663, 682, 725, 726, 777, 791, 818, 866, 901, 909, 939, 951, 958, 970, 971, 975, 992, 1004, 1007, 1016, 1017, 1021, 1025, 1029, 1037, 1040, 1043, 1044, 1045, 1047, 1048, 1049, 1052, 1065, 1069, or a combination thereof of the PIK3CA polypeptide. In some embodiments, the polynucleic acid molecule is a polynucleic acid molecule that hybridizes to a target region of PIK3CA DNA or RNA comprising one or more mutations at positions corresponding to amino acid residues selected from M1V, R4 (nonsense mutation), L10-M16 (deletion), W11-P18 (deletion), W11L, G12D, R38L, R38H, R38C, R38S, E39K, E39G, E65K, S72G, Q75E, R79M, E81K, E81 (deletion), F83Y, R88Q, C90Y, C90G, R93Q, R93W, I102 (deletion), E103G, E103-P104 (deletion), E103-G106 (deletion), P104L, V105-R108 (deletion), G106V, G106-N107 (deletion), G106-R108 (deletion), G106R, N107S, R108L, R108H, E109-I112 (deletion), E110 (deletion), K111E, K111R, K111N, K111 (deletion), L113 (deletion), RI 15L, Q137L, N170S, D258N, Y272 (nonsense mutation), L279I, G320V, W328S, R335G, T342S, V344G, V344M, V344A, N345K, N345I, N345T, D350N, D350G, R357Q, G359R, G363A, G364R, E365K, E365V, P366R, C378R, C378Y, R398H, R401Q, E417K, C420R, C420G, P447-L455 (deletion), P449L, P449-N457 (deletion), G451R, G451V, E453K, E453Q, E453D, D454Y, L455 (frame shift insertion), L455-G460 (deletion), G463-N465 (deletion), P471L, P471A, H495L, H495Y, E522A, D538N, P539R, E542K, E542V, E542G, E542Q, E542A, E545K, E545A, E545G, E545Q, E545D, Q546K, Q546R, Q546P, E547D, S576Y, C604R, F614I, A617W, S629C, Q643H, I663S, Q682 (deletion), D725N, W726K, R777M, E791Q, R818C, L866W, C901F, F909L, D939G, R951C, Q958R, E970K, C971R, R975S, R992P, M10041, G1007R, F1016C, D1017H, Y1021H, Y1021C, T1025A, T1025S, D1029H, E1037K, M1040V, M1043V, M10431, N1044K, N1044Y, D1045V, H1047R, H1047L, H1047Y, H1047Q, H1048R, G1049R, T1052K, H1065L, 1069W (nonstop mutation), or a combination thereof of the PIK3CB polypeptide.

In some embodiments, beta-catenin associated genes further comprise PIK3CB. In some embodiments, PIK3CB gene is wild type or comprises one or more mutations. In some instances, PIK3CB DNA or RNA is wild type PIK3CB DNA or RNA. In some instances, PIK3CB DNA or RNA comprises one or more mutations. In some instances, the polynucleic acid molecule hybridizes to a target region of wild type PIK3CB DNA or RNA. In some instances, the polynucleic acid molecule hybridizes to a target region of PIK3CB DNA or RNA comprising a mutation (e.g., a substitution, a deletion, or an addition).

In some embodiments, PIK3CB DNA or RNA comprises one or more mutations. In some embodiments, PIK3CB DNA or RNA comprises one or more mutations within one or more exons. In some instances, PIK3CB DNA or RNA comprises one or more mutations at positions corresponding to amino acid residues 18, 19, 21, 28, 50, 61, 68, 103, 135, 140, 167, 252, 270, 290, 301, 304, 321, 369, 417, 442, 470, 497, 507, 512, 540, 551, 552, 554, 562, 567, 593, 595, 619, 628, 668, 768, 805, 824, 830, 887, 967, 992, 1005, 1020, 1036, 1046, 1047, 1048, 1049, 1051, 1055, 1067, or a combination thereof of the PIK3CB polypeptide. In some embodiments, PIK3CB DNA or RNA comprises one or more mutations at positions corresponding to amino acid residues selected from W18 (nonsense mutation), A19V, D21H, G28S, A50P, K61T, M68I, R103K, H135N, L140S, S167C, G252W, R270W, K290N, E301V, I304R, R321Q, V369I, T417M, N442K, E470K, E497D, P507S, I512M, E540 (nonsense mutation), C551R, E552K, E554K, R562 (nonsense mutation), E567D, A593V, L595P, V619A, R628 (nonsense mutation), R668W, L768F, K805E, D824E, A830T, E887 (nonsense mutation), V967A, I992T, A1005V, D1020H, E1036K, D1046N, E1047K, A1048V, L1049R, E1051K, T1055A, D1067V, D1067A, or a combination thereof of the PIK3CB polypeptide.

In some embodiments, the polynucleic acid molecule hybridizes to a target region of PIK3CB DNA or RNA comprising one or more mutations. In some embodiments, the polynucleic acid molecule hybridizes to a target region of PIK3CB DNA or RNA comprising one or more mutations within an exon. In some embodiments, the polynucleic acid molecule hybridizes to a target region of PIK3CB DNA or RNA comprising one or more mutations at positions corresponding to amino acid residues 18, 19, 21, 28, 50, 61, 68, 103, 135, 140, 167, 252, 270, 290, 301, 304, 321, 369, 417, 442, 470, 497, 507, 512, 540, 551, 552, 554, 562, 567, 593, 595, 619, 628, 668, 768, 805, 824, 830, 887, 967, 992, 1005, 1020, 1036, 1046, 1047, 1048, 1049, 1051, 1055, 1067, or a combination thereof of the PIK3CB polypeptide. In some embodiments, the polynucleic acid molecule hybridizes to a target region of PIK3CB DNA or RNA comprising one or more mutations at positions corresponding to amino acid residues selected from W18 (nonsense mutation), A19V, D21H, G28S, A50P, K61T, M68I, R103K, H135N, L140S, S167C, G252W, R270W, K290N, E301V, 1304R, R321Q, V369I, T417M, N442K, E470K, E497D, P507S, I512M, E540 (nonsense mutation), C551R, E552K, E554K, R562 (nonsense mutation), E567D, A593V, L595P, V619A, R628 (nonsense mutation), R668W, L768F, K805E, D824E, A830T, E887 (nonsense mutation), V967A, I992T, A1005V, D1020H, E1036K, D1046N, E1047K, A1048V, L1049R, E1051K, T1055A, D1067V, D1067A, or a combination thereof of the PIK3CB polypeptide.

In some embodiments, beta-catenin associated genes further comprise MYC. In some embodiments, MYC gene is wild type MYC or MYC comprising one or more mutations. In some instances, MYC is wild type MYC DNA or RNA. In some instances, MYC DNA or RNA comprises one or more mutations. In some instances, the polynucleic acid molecule hybridizes to a target region of wild type MYC DNA or RNA. In some instances, the polynucleic acid molecule is a polynucleic acid molecule that hybridizes to a target region of MYC DNA or RNA comprising a mutation (e.g., a substitution, a deletion, or an addition).

In some embodiments, MYC DNA or RNA comprises one or more mutations. In some embodiments, MYC DNA or RNA comprises one or more mutation within one or more exons. In some instances, MYC DNA or RNA comprises one or more mutations within exon 2 or exon 3. In some instances, MYC DNA or RNA comprises one or more mutations at positions corresponding to amino acid residues 2, 7, 17, 20, 32, 44, 58, 59, 76, 115, 138, 141, 145, 146, 169, 175, 188, 200, 202, 203, 248, 251, 298, 321, 340, 369, 373, 374, 389, 395, 404, 419, 431, 439, or a combination thereof. In some embodiments, MYC DNA or RNA comprises one or more mutations at positions corresponding to amino acid residues selected from P2L, F7L, D17N, Q20E, Y32N, A44V, A44T, T58I, P59L, A76V, F115L, F138S, A141S, V1451, S146L, S169C, S175N, C188F, N200S, S202N, S2031, T248S, D251E, S298Y, Q321E, V340D, V369D, T373K, H374R, F389L, Q395H, K404N, L419M, E431K, R439Q, or a combination thereof of the MYC polypeptide.

In some embodiments, the polynucleic acid molecule hybridizes to a target region of MYC DNA or RNA comprising one or more mutations. In some embodiments, the polynucleic acid molecule hybridizes to a target region of MYC DNA or RNA comprising one or more mutations within an exon. In some embodiments, the polynucleic acid molecule hybridizes to a target region of MYC DNA or RNA comprising one or more mutations within exon 2 or exon 3. In some embodiments, the polynucleic acid molecule hybridizes to a target region of MYC DNA or RNA comprising one or more mutations at positions corresponding to amino acid residues 2, 7, 17, 20, 32, 44, 58, 59, 76, 115, 138, 141, 145, 146, 169, 175, 188, 200, 202, 203, 248, 251, 298, 321, 340, 369, 373, 374, 389, 395, 404, 419, 431, 439, or a combination thereof of the MYC polypeptide. In some embodiments, the polynucleic acid molecule hybridizes to a target region of MYC DNA or RNA comprising one or more mutations at positions corresponding to amino acid residues selected from P2L, F7L, D17N, Q20E, Y32N, A44V, A44T, T58I, P59L, A76V, F115L, F138S, A141S, V145I, S146L, S169C, S175N, C188F, N200S, S202N, S203T, T248S, D251E, S298Y, Q321E, V340D, V369D, T373K, H374R, F389L, Q395H, K404N, L419M, E431K, R439Q, or a combination thereof of the MYC polypeptide.

Polyncleic Acid Molecules that Target Hypoxanthine Phosphoribosyltransferase 1 (HPRT1)

Hypoxanthine-guanine phosphoribosyltransferase (HGPRT) is a transferase that catalyzes the conversion of hypoxanthine to inosine monophosphate and guanine to guanosine monophosphate. HGPRT is encoded by the hypoxanthine Phosphoribosyltransferase 1 (HPRT1) gene.

In some embodiments, HPRT1 DNA or RNA is wild type or comprises one or more mutations. In some instances, HPRT1 DNA or RNA comprises one or more mutations within one or more exons. In some instances, the one or more exons comprise exon 2, exon 3, exon 4, exon 6, exon 8, or exon 9. In some instances, HPRT1 DNA or RNA comprises one or more mutations at positions corresponding to amino acid residues 35, 48, 56, 74, 87, 129, 154, 162, 195, 200, 210, or a combination thereof of the HPRT1 polypeptide. In some embodiments, the polynucleic acid molecule hybridizes to a target region of HPRT1 DNA or RNA comprising one or more mutations selected from V35M, R48H, E56D, F74L, R87I, N129 (splice-site mutation), N154H, 5162 (splice-site mutation), Y195C, Y195N, R200M, E210K, or a combination thereof of the HPRT1 polypeptide.

In some embodiments, the polynucleic acid molecule hybridizes to a target region of HPRT1 DNA or RNA comprising one or more mutations. In some embodiments, the polynucleic acid molecule hybridizes to a target region of HPRT1 DNA or RNA comprising one or more mutations within exon 2, exon 3, exon 4, exon 6, exon 8, or exon 9. In some embodiments, the polynucleic acid molecule hybridizes to a target region of HPRT1 DNA or RNA comprising one or more mutations at positions corresponding to amino acid residues 35, 48, 56, 74, 87, 129, 154, 162, 195, 200, 210, or a combination thereof of the HPRT1 polypeptide. In some embodiments, the polynucleic acid molecule hybridizes to a target region of HPRT1 DNA or RNA comprising one or more mutations selected from V35M, R48H, E56D, F74L, R87I, N129 (splice-site mutation), N154H, S162 (splice-site mutation), Y195C, Y195N, R200M, E210K, or a combination thereof of the HPRT1 polypeptide.

Polynucleic Acid Molecule Sequences

In some embodiments, the polynucleic acid molecule comprises a sequence that hybridizes to a target sequence illustrated in Tables 1, 4, 7, 8, or 10. In some instances, the polynucleic acid molecule is B. In some instances, the polynucleic acid molecule B comprises a sequence that hybridizes to a target sequence illustrated in Table 1 (KRAS target sequences). In some instances, the polynucleic acid molecule B comprises a sequence that hybridizes to a target sequence illustrated in Table 4 (EGFR target sequences). In some cases, the polynucleic acid molecule B comprises a sequence that hybridizes to a target sequence illustrated in Table 7 (AR target sequences). In some cases, the polynucleic acid molecule B comprises a sequence that hybridizes to a target sequence illustrated in Table 8 ((3-catenin target sequences). In additional cases, the polynucleic acid molecule B comprises a sequence that hybridizes to a target sequence illustrated in Table 10 (PIK3CA and PIK3CB target sequences).

In some embodiments, the polynucleic acid molecule B comprises a sequence having at least 50%, 55%, 60%, 65%, 70%, 75%, 80%, 85%, 90%, 95%, 96%, 97%, 98%, 99%, or 100% sequence identity to a sequence listed in Table 2 or Table 3. In some embodiments, the polynucleic acid molecule comprises a sequence having at least 50%, 55%, 60%, 65%, 70%, 75%, 80%, 85%, 90%, 95%, 96%, 97%, 98%, 99%, or 100% sequence identity to SEQ ID NOs: 16-75. In some embodiments, the polynucleic acid molecule comprises a sequence having at least 50% sequence identity to SEQ ID NOs: 16-75. In some embodiments, the polynucleic acid molecule comprises a sequence having at least 60% sequence identity to SEQ ID NOs: 16-75. In some embodiments, the polynucleic acid molecule comprises a sequence having at least 70% sequence identity to SEQ ID NOs: 16-75. In some embodiments, the polynucleic acid molecule comprises a sequence having at least 75% sequence identity to SEQ ID NOs: 16-75. In some embodiments, the polynucleic acid molecule comprises a sequence having at least 80% sequence identity to SEQ ID NOs: 16-75. In some embodiments, the polynucleic acid molecule comprises a sequence having at least 85% sequence identity to SEQ ID NOs: 16-75. In some embodiments, the polynucleic acid molecule comprises a sequence having at least 90% sequence identity to SEQ ID NOs: 16-75. In some embodiments, the polynucleic acid molecule comprises a sequence having at least 95% sequence identity to SEQ ID NOs: 16-75. In some embodiments, the polynucleic acid molecule comprises a sequence having at least 96% sequence identity to SEQ ID NOs: 16-75. In some embodiments, the polynucleic acid molecule comprises a sequence having at least 97% sequence identity to SEQ ID NOs: 16-75. In some embodiments, the polynucleic acid molecule comprises a sequence having at least 98% sequence identity to SEQ ID NOs: 16-75. In some embodiments, the polynucleic acid molecule comprises a sequence having at least 99% sequence identity to SEQ ID NOs: 16-75. In some embodiments, the polynucleic acid molecule consists of SEQ ID NOs: 16-75.

In some embodiments, the polynucleic acid molecule B comprises a first polynucleotide and a second polynucleotide. In some instances, the first polynucleotide comprises a sequence having at least 50%, 55%, 60%, 65%, 70%, 75%, 80%, 85%, 90%, 95%, 96%, 97%, 98%, 99%, or 100% sequence identity to SEQ ID NOs: 16-75. In some cases, the second polynucleotide comprises a sequence having at least 50%, 55%, 60%, 65%, 70%, 75%, 80%, 85%, 90%, 95%, 96%, 97%, 98%, 99%, or 100% sequence identity to SEQ ID NOs: 16-75. In some cases, the polynucleic acid molecule comprises a first polynucleotide having at least 50%, 55%, 60%, 65%, 70%, 75%, 80%, 85%, 90%, 95%, 96%, 97%, 98%, 99%, or 100% sequence identity to SEQ ID NOs: 16-75 and a second polynucleotide having at least 50%, 55%, 60%, 65%, 70%, 75%, 80%, 85%, 90%, 95%, 96%, 97%, 98%, 99%, or 100% sequence identity to SEQ ID NOs: 16-75.

In some embodiments, the polynucleic acid molecule B comprises a sequence having at least 50%, 55%, 60%, 65%, 70%, 75%, 80%, 85%, 90%, 95%, 96%, 97%, 98%, 99%, or 100% sequence identity to a sequence listed in Table 5 or Table 6. In some embodiments, the polynucleic acid molecule comprises a sequence having at least 50%, 55%, 60%, 65%, 70%, 75%, 80%, 85%, 90%, 95%, 96%, 97%, 98%, 99%, or 100% sequence identity to SEQ ID NOs: 452-1955. In some embodiments, the polynucleic acid molecule comprises a sequence having at least 50% sequence identity to SEQ ID NOs: 452-1955. In some embodiments, the polynucleic acid molecule comprises a sequence having at least 60% sequence identity to SEQ ID NOs: 452-1955. In some embodiments, the polynucleic acid molecule comprises a sequence having at least 70% sequence identity to SEQ ID NOs: 452-1955. In some embodiments, the polynucleic acid molecule comprises a sequence having at least 75% sequence identity to SEQ ID NOs: 452-1955. In some embodiments, the polynucleic acid molecule comprises a sequence having at least 80% sequence identity to SEQ ID NOs: 452-1955. In some embodiments, the polynucleic acid molecule comprises a sequence having at least 85% sequence identity to SEQ ID NOs: 452-1955. In some embodiments, the polynucleic acid molecule comprises a sequence having at least 90% sequence identity to SEQ ID NOs: 452-1955. In some embodiments, the polynucleic acid molecule comprises a sequence having at least 95% sequence identity to SEQ ID NOs: 452-1955. In some embodiments, the polynucleic acid molecule comprises a sequence having at least 96% sequence identity to SEQ ID NOs: 452-1955. In some embodiments, the polynucleic acid molecule comprises a sequence having at least 97% sequence identity to SEQ ID NOs: 452-1955. In some embodiments, the polynucleic acid molecule comprises a sequence having at least 98% sequence identity to SEQ ID NOs: 452-1955. In some embodiments, the polynucleic acid molecule comprises a sequence having at least 99% sequence identity to SEQ ID NOs: 452-1955. In some embodiments, the polynucleic acid molecule consists of SEQ ID NOs: 452-1955.

In some embodiments, the polynucleic acid molecule B comprises a first polynucleotide and a second polynucleotide. In some instances, the first polynucleotide comprises a sequence having at least 50%, 55%, 60%, 65%, 70%, 75%, 80%, 85%, 90%, 95%, 96%, 97%, 98%, 99%, or 100% sequence identity to SEQ ID NOs: 452-1955. In some cases, the second polynucleotide comprises a sequence having at least 50%, 55%, 60%, 65%, 70%, 75%, 80%, 85%, 90%, 95%, 96%, 97%, 98%, 99%, or 100% sequence identity to SEQ ID NOs: 452-1955. In some cases, the polynucleic acid molecule comprises a first polynucleotide having at least 50%, 55%, 60%, 65%, 70%, 75%, 80%, 85%, 90%, 95%, 96%, 97%, 98%, 99%, or 100% sequence identity to SEQ ID NOs: 452-1955 and a second polynucleotide having at least 50%, 55%, 60%, 65%, 70%, 75%, 80%, 85%, 90%, 95%, 96%, 97%, 98%, 99%, or 100% sequence identity to SEQ ID NOs: 452-1955.

In some embodiments, the polynucleic acid molecule B comprises a sequence having at least 50%, 55%, 60%, 65%, 70%, 75%, 80%, 85%, 90%, 95%, 96%, 97%, 98%, 99%, or 100% sequence identity to a sequence listed in Table 7. In some embodiments, the polynucleic acid molecule comprises a sequence having at least 50%, 55%, 60%, 65%, 70%, 75%, 80%, 85%, 90%, 95%, 96%, 97%, 98%, 99%, or 100% sequence identity to SEQ ID NOs: 1956-1962. In some embodiments, the polynucleic acid molecule comprises a sequence having at least 50% sequence identity to SEQ ID NOs: 1956-1962. In some embodiments, the polynucleic acid molecule comprises a sequence having at least 60% sequence identity to SEQ ID NOs: 1956-1962. In some embodiments, the polynucleic acid molecule comprises a sequence having at least 70% sequence identity to SEQ ID NOs: 1956-1962. In some embodiments, the polynucleic acid molecule comprises a sequence having at least 75% sequence identity to SEQ ID NOs: 1956-1962. In some embodiments, the polynucleic acid molecule comprises a sequence having at least 80% sequence identity to SEQ ID NOs: 1956-1962. In some embodiments, the polynucleic acid molecule comprises a sequence having at least 85% sequence identity to SEQ ID NOs: 1956-1962. In some embodiments, the polynucleic acid molecule comprises a sequence having at least 90% sequence identity to SEQ ID NOs: 1956-1962. In some embodiments, the polynucleic acid molecule comprises a sequence having at least 95% sequence identity to SEQ ID NOs: 1956-1962. In some embodiments, the polynucleic acid molecule comprises a sequence having at least 96% sequence identity to SEQ ID NOs: 1956-1962. In some embodiments, the polynucleic acid molecule comprises a sequence having at least 97% sequence identity to SEQ ID NOs: 1956-1962. In some embodiments, the polynucleic acid molecule comprises a sequence having at least 98% sequence identity to SEQ ID NOs: 1956-1962. In some embodiments, the polynucleic acid molecule comprises a sequence having at least 99% sequence identity to SEQ ID NOs: 1956-1962. In some embodiments, the polynucleic acid molecule consists of SEQ ID NOs: 1956-1962.

In some embodiments, the polynucleic acid molecule B comprises a first polynucleotide and a second polynucleotide. In some instances, the first polynucleotide comprises a sequence having at least 50%, 55%, 60%, 65%, 70%, 75%, 80%, 85%, 90%, 95%, 96%, 97%, 98%, 99%, or 100% sequence identity to SEQ ID NOs: 1956-1962. In some cases, the second polynucleotide comprises a sequence that is complementary to a sequence having at least 50%, 55%, 60%, 65%, 70%, 75%, 80%, 85%, 90%, 95%, 96%, 97%, 98%, 99%, or 100% sequence identity to SEQ ID NOs: 1956-1962. In some instances, the polynucleic acid molecule comprises a first polynucleotide having at least 50%, 55%, 60%, 65%, 70%, 75%, 80%, 85%, 90%, 95%, 96%, 97%, 98%, 99%, or 100% sequence identity to SEQ ID NOs: 1956-1962, and a second polynucleotide that is complementary to a sequence having at least 50%, 55%, 60%, 65%, 70%, 75%, 80%, 85%, 90%, 95%, 96%, 97%, 98%, 99%, or 100% sequence identity to SEQ ID NOs: 1956-1962.

In some embodiments, the polynucleic acid molecule B comprises a sequence having at least 50%, 55%, 60%, 65%, 70%, 75%, 80%, 85%, 90%, 95%, 96%, 97%, 98%, 99%, or 100% sequence identity to a sequence listed in Table 9. In some embodiments, the polynucleic acid molecule comprises a sequence having at least 50%, 55%, 60%, 65%, 70%, 75%, 80%, 85%, 90%, 95%, 96%, 97%, 98%, 99%, or 100% sequence identity to SEQ ID NOs: 1967-2002. In some embodiments, the polynucleic acid molecule comprises a sequence having at least 50% sequence identity to SEQ ID NOs: 1967-2002. In some embodiments, the polynucleic acid molecule comprises a sequence having at least 60% sequence identity to SEQ ID NOs: 1967-2002. In some embodiments, the polynucleic acid molecule comprises a sequence having at least 70% sequence identity to SEQ ID NOs: 1967-2002. In some embodiments, the polynucleic acid molecule comprises a sequence having at least 75% sequence identity to SEQ ID NOs: 1967-2002. In some embodiments, the polynucleic acid molecule comprises a sequence having at least 80% sequence identity to SEQ ID NOs: 1967-2002. In some embodiments, the polynucleic acid molecule comprises a sequence having at least 85% sequence identity to SEQ ID NOs: 1967-2002. In some embodiments, the polynucleic acid molecule comprises a sequence having at least 90% sequence identity to SEQ ID NOs: 1967-2002. In some embodiments, the polynucleic acid molecule comprises a sequence having at least 95% sequence identity to SEQ ID NOs: 1967-2002. In some embodiments, the polynucleic acid molecule comprises a sequence having at least 96% sequence identity to SEQ ID NOs: 1967-2002. In some embodiments, the polynucleic acid molecule comprises a sequence having at least 97% sequence identity to SEQ ID NOs: 1967-2002. In some embodiments, the polynucleic acid molecule comprises a sequence having at least 98% sequence identity to SEQ ID NOs: 1967-2002. In some embodiments, the polynucleic acid molecule comprises a sequence having at least 99% sequence identity to SEQ ID NOs: 1967-2002. In some embodiments, the polynucleic acid molecule consists of SEQ ID NOs: 1967-2002.

In some embodiments, the polynucleic acid molecule B comprises a first polynucleotide and a second polynucleotide. In some instances, the first polynucleotide comprises a sequence having at least 50%, 55%, 60%, 65%, 70%, 75%, 80%, 85%, 90%, 95%, 96%, 97%, 98%, 99%, or 100% sequence identity to SEQ ID NOs: 1967-2002. In some cases, the second polynucleotide comprises a sequence having at least 50%, 55%, 60%, 65%, 70%, 75%, 80%, 85%, 90%, 95%, 96%, 97%, 98%, 99%, or 100% sequence identity to SEQ ID NOs: 1967-2002. In some cases, the polynucleic acid molecule comprises a first polynucleotide having at least 50%, 55%, 60%, 65%, 70%, 75%, 80%, 85%, 90%, 95%, 96%, 97%, 98%, 99%, or 100% sequence identity to SEQ ID NOs: 1967-2002 and a second polynucleotide having at least 50%, 55%, 60%, 65%, 70%, 75%, 80%, 85%, 90%, 95%, 96%, 97%, 98%, 99%, or 100% sequence identity to SEQ ID NOs: 1967-2002.

In some embodiments, the polynucleic acid molecule B comprises a sequence having at least 50%, 55%, 60%, 65%, 70%, 75%, 80%, 85%, 90%, 95%, 96%, 97%, 98%, 99%, or 100% sequence identity to a sequence listed in Table 11. In some embodiments, the polynucleic acid molecule comprises a sequence having at least 50%, 55%, 60%, 65%, 70%, 75%, 80%, 85%, 90%, 95%, 96%, 97%, 98%, 99%, or 100% sequence identity to SEQ ID NOs: 2013-2032. In some embodiments, the polynucleic acid molecule comprises a sequence having at least 50% sequence identity to SEQ ID NOs: 2013-2032. In some embodiments, the polynucleic acid molecule comprises a sequence having at least 60% sequence identity to SEQ ID NOs: 2013-2032. In some embodiments, the polynucleic acid molecule comprises a sequence having at least 70% sequence identity to SEQ ID NOs: 2013-2032. In some embodiments, the polynucleic acid molecule comprises a sequence having at least 75% sequence identity to SEQ ID NOs: 2013-2032. In some embodiments, the polynucleic acid molecule comprises a sequence having at least 80% sequence identity to SEQ ID NOs: 2013-2032. In some embodiments, the polynucleic acid molecule comprises a sequence having at least 85% sequence identity to SEQ ID NOs: 2013-2032. In some embodiments, the polynucleic acid molecule comprises a sequence having at least 90% sequence identity to SEQ ID NOs: 2013-2032. In some embodiments, the polynucleic acid molecule comprises a sequence having at least 95% sequence identity to SEQ ID NOs: 2013-2032. In some embodiments, the polynucleic acid molecule comprises a sequence having at least 96% sequence identity to SEQ ID NOs: 2013-2032. In some embodiments, the polynucleic acid molecule comprises a sequence having at least 97% sequence identity to SEQ ID NOs: 2013-2032. In some embodiments, the polynucleic acid molecule comprises a sequence having at least 98% sequence identity to SEQ ID NOs: 2013-2032. In some embodiments, the polynucleic acid molecule comprises a sequence having at least 99% sequence identity to SEQ ID NOs: 2013-2032. In some embodiments, the polynucleic acid molecule consists of SEQ ID NOs: 2013-2032.

In some embodiments, the polynucleic acid molecule B comprises a first polynucleotide and a second polynucleotide. In some instances, the first polynucleotide comprises a sequence having at least 50%, 55%, 60%, 65%, 70%, 75%, 80%, 85%, 90%, 95%, 96%, 97%, 98%, 99%, or 100% sequence identity to SEQ ID NOs: 2013-2032. In some cases, the second polynucleotide comprises a sequence having at least 50%, 55%, 60%, 65%, 70%, 75%, 80%, 85%, 90%, 95%, 96%, 97%, 98%, 99%, or 100% sequence identity to SEQ ID NOs: 2013-2032. In some cases, the polynucleic acid molecule comprises a first polynucleotide having at least 50%, 55%, 60%, 65%, 70%, 75%, 80%, 85%, 90%, 95%, 96%, 97%, 98%, 99%, or 100% sequence identity to SEQ ID NOs: 2013-2032 and a second polynucleotide having at least 50%, 55%, 60%, 65%, 70%, 75%, 80%, 85%, 90%, 95%, 96%, 97%, 98%, 99%, or 100% sequence identity to SEQ ID NOs: 2013-2032.

In some embodiments, the polynucleic acid molecule B comprises a sequence having at least 50%, 55%, 60%, 65%, 70%, 75%, 80%, 85%, 90%, 95%, 96%, 97%, 98%, 99%, or 100% sequence identity to a sequence listed in Table 12.

In some embodiments, the polynucleic acid molecule comprises a sequence having at least 50%, 55%, 60%, 65%, 70%, 75%, 80%, 85%, 90%, 95%, 96%, 97%, 98%, 99%, or 100% sequence identity to SEQ ID NOs: 2082-2109 or 2117. In some embodiments, the polynucleic acid molecule comprises a sequence having at least 50% sequence identity to SEQ ID NOs: 2082-2109 or 2117. In some embodiments, the polynucleic acid molecule comprises a sequence having at least 60% sequence identity to SEQ ID NOs: 2082-2109 or 2117. In some embodiments, the polynucleic acid molecule comprises a sequence having at least 70% sequence identity to SEQ ID NOs: 2082-2109 or 2117. In some embodiments, the polynucleic acid molecule comprises a sequence having at least 75% sequence identity to SEQ ID NOs: 2082-2109 or 2117. In some embodiments, the polynucleic acid molecule comprises a sequence having at least 80% sequence identity to SEQ ID NOs: 2082-2109 or 2117. In some embodiments, the polynucleic acid molecule comprises a sequence having at least 85% sequence identity to SEQ ID NOs: 2082-2109 or 2117. In some embodiments, the polynucleic acid molecule comprises a sequence having at least 90% sequence identity to SEQ ID NOs: 2082-2109 or 2117. In some embodiments, the polynucleic acid molecule comprises a sequence having at least 95% sequence identity to SEQ ID NOs: 2082-2109 or 2117. In some embodiments, the polynucleic acid molecule comprises a sequence having at least 96% sequence identity to SEQ ID NOs: 2082-2109 or 2117. In some embodiments, the polynucleic acid molecule comprises a sequence having at least 97% sequence identity to SEQ ID NOs: 2082-2109 or 2117. In some embodiments, the polynucleic acid molecule comprises a sequence having at least 98% sequence identity to SEQ ID NOs: 2082-2109 or 2117. In some embodiments, the polynucleic acid molecule comprises a sequence having at least 99% sequence identity to SEQ ID NOs: 2082-2109 or 2117. In some embodiments, the polynucleic acid molecule consists of SEQ ID NOs: 2082-2109 or 2117.

In some embodiments, the polynucleic acid molecule B comprises a first polynucleotide and a second polynucleotide. In some instances, the first polynucleotide comprises a sequence having at least 50%, 55%, 60%, 65%, 70%, 75%, 80%, 85%, 90%, 95%, 96%, 97%, 98%, 99%, or 100% sequence identity to SEQ ID NOs: 2082-2109 or 2117. In some cases, the second polynucleotide comprises a sequence having at least 50%, 55%, 60%, 65%, 70%, 75%, 80%, 85%, 90%, 95%, 96%, 97%, 98%, 99%, or 100% sequence identity to SEQ ID NOs: 2082-2109 or 2117. In some cases, the polynucleic acid molecule comprises a first polynucleotide having at least 50%, 55%, 60%, 65%, 70%, 75%, 80%, 85%, 90%, 95%, 96%, 97%, 98%, 99%, or 100% sequence identity to SEQ ID NOs: 2082-2109 or 2117 and a second polynucleotide having at least 50%, 55%, 60%, 65%, 70%, 75%, 80%, 85%, 90%, 95%, 96%, 97%, 98%, 99%, or 100% sequence identity to SEQ ID NOs: 2082-2109 or 2117.

Polynucleic Acid Molecules

In some embodiments, the polynucleic acid molecule described herein comprises RNA or DNA. In some cases, the polynucleic acid molecule comprises RNA. In some instances, RNA comprises short interfering RNA (siRNA), short hairpin RNA (shRNA), microRNA (miRNA), double-stranded RNA (dsRNA), transfer RNA (tRNA), ribosomal RNA (rRNA), or heterogeneous nuclear RNA (hnRNA). In some instances, RNA comprises shRNA. In some instances, RNA comprises miRNA. In some instances, RNA comprises dsRNA. In some instances, RNA comprises tRNA. In some instances, RNA comprises rRNA. In some instances, RNA comprises hnRNA. In some instances, the RNA comprises siRNA. In some instances, the polynucleic acid molecule comprises siRNA. In some cases, B comprises siRNA.

In some embodiments, the polynucleic acid molecule is from about 10 to about 50 nucleotides in length. In some instances, the polynucleic acid molecule is from about 10 to about 30, from about 15 to about 30, from about 18 to about 25, from about 18 to about 24, from about 19 to about 23, or from about 20 to about 22 nucleotides in length.

In some embodiments, the polynucleic acid molecule is about 50 nucleotides in length. In some instances, the polynucleic acid molecule is about 45 nucleotides in length. In some instances, the polynucleic acid molecule is about 40 nucleotides in length. In some instances, the polynucleic acid molecule is about 35 nucleotides in length. In some instances, the polynucleic acid molecule is about 30 nucleotides in length. In some instances, the polynucleic acid molecule is about 25 nucleotides in length. In some instances, the polynucleic acid molecule is about 20 nucleotides in length. In some instances, the polynucleic acid molecule is about 19 nucleotides in length. In some instances, the polynucleic acid molecule is about 18 nucleotides in length. In some instances, the polynucleic acid molecule is about 17 nucleotides in length. In some instances, the polynucleic acid molecule is about 16 nucleotides in length. In some instances, the polynucleic acid molecule is about 15 nucleotides in length. In some instances, the polynucleic acid molecule is about 14 nucleotides in length. In some instances, the polynucleic acid molecule is about 13 nucleotides in length. In some instances, the polynucleic acid molecule is about 12 nucleotides in length. In some instances, the polynucleic acid molecule is about 11 nucleotides in length. In some instances, the polynucleic acid molecule is about 10 nucleotides in length. In some instances, the polynucleic acid molecule is from about 10 to about 50 nucleotides in length. In some instances, the polynucleic acid molecule is from about 10 to about 45 nucleotides in length. In some instances, the polynucleic acid molecule is from about 10 to about 40 nucleotides in length. In some instances, the polynucleic acid molecule is from about 10 to about 35 nucleotides in length. In some instances, the polynucleic acid molecule is from about 10 to about 30 nucleotides in length. In some instances, the polynucleic acid molecule is from about 10 to about 25 nucleotides in length. In some instances, the polynucleic acid molecule is from about 10 to about 20 nucleotides in length. In some instances, the polynucleic acid molecule is from about 15 to about 25 nucleotides in length. In some instances, the polynucleic acid molecule is from about 15 to about 30 nucleotides in length. In some instances, the polynucleic acid molecule is from about 12 to about 30 nucleotides in length.

In some embodiments, the polynucleic acid molecule comprises a first polynucleotide. In some instances, the polynucleic acid molecule comprises a second polynucleotide. In some instances, the polynucleic acid molecule comprises a first polynucleotide and a second polynucleotide. In some instances, the first polynucleotide is a sense strand or passenger strand. In some instances, the second polynucleotide is an antisense strand or guide strand.

In some embodiments, the polynucleic acid molecule is a first polynucleotide. In some embodiments, the first polynucleotide is from about 10 to about 50 nucleotides in length. In some instances, the first polynucleotide is from about 10 to about 30, from about 15 to about 30, from about 18 to about 25, from about 18 to about 24, from about 19 to about 23, or from about 20 to about 22 nucleotides in length.

In some instances, the first polynucleotide is about 50 nucleotides in length. In some instances, the first polynucleotide is about 45 nucleotides in length. In some instances, the first polynucleotide is about 40 nucleotides in length. In some instances, the first polynucleotide is about 35 nucleotides in length. In some instances, the first polynucleotide is about 30 nucleotides in length. In some instances, the first polynucleotide is about 25 nucleotides in length. In some instances, the first polynucleotide is about 20 nucleotides in length. In some instances, the first polynucleotide is about 19 nucleotides in length. In some instances, the first polynucleotide is about 18 nucleotides in length. In some instances, the first polynucleotide is about 17 nucleotides in length. In some instances, the first polynucleotide is about 16 nucleotides in length. In some instances, the first polynucleotide is about 15 nucleotides in length. In some instances, the first polynucleotide is about 14 nucleotides in length. In some instances, the first polynucleotide is about 13 nucleotides in length. In some instances, the first polynucleotide is about 12 nucleotides in length. In some instances, the first polynucleotide is about 11 nucleotides in length. In some instances, the first polynucleotide is about 10 nucleotides in length. In some instances, the first polynucleotide is from about 10 to about 50 nucleotides in length. In some instances, the first polynucleotide is from about 10 to about 45 nucleotides in length. In some instances, the first polynucleotide is from about 10 to about 40 nucleotides in length. In some instances, the first polynucleotide is from about 10 to about 35 nucleotides in length. In some instances, the first polynucleotide is from about 10 to about 30 nucleotides in length. In some instances, the first polynucleotide is from about 10 to about 25 nucleotides in length. In some instances, the first polynucleotide is from about 10 to about 20 nucleotides in length. In some instances, the first polynucleotide is from about 15 to about 25 nucleotides in length. In some instances, the first polynucleotide is from about 15 to about 30 nucleotides in length. In some instances, the first polynucleotide is from about 12 to about 30 nucleotides in length.

In some embodiments, the polynucleic acid molecule is a second polynucleotide. In some embodiments, the second polynucleotide is from about 10 to about 50 nucleotides in length. In some instances, the second polynucleotide is from about 10 to about 30, from about 15 to about 30, from about 18 to about 25, from about 18 to about 24, from about 19 to about 23, or from about 20 to about 22 nucleotides in length.

In some instances, the second polynucleotide is about 50 nucleotides in length. In some instances, the second polynucleotide is about 45 nucleotides in length. In some instances, the second polynucleotide is about 40 nucleotides in length. In some instances, the second polynucleotide is about 35 nucleotides in length. In some instances, the second polynucleotide is about 30 nucleotides in length. In some instances, the second polynucleotide is about 25 nucleotides in length. In some instances, the second polynucleotide is about 20 nucleotides in length. In some instances, the second polynucleotide is about 19 nucleotides in length. In some instances, the second polynucleotide is about 18 nucleotides in length. In some instances, the second polynucleotide is about 17 nucleotides in length. In some instances, the second polynucleotide is about 16 nucleotides in length. In some instances, the second polynucleotide is about 15 nucleotides in length. In some instances, the second polynucleotide is about 14 nucleotides in length. In some instances, the second polynucleotide is about 13 nucleotides in length. In some instances, the second polynucleotide is about 12 nucleotides in length. In some instances, the second polynucleotide is about 11 nucleotides in length. In some instances, the second polynucleotide is about 10 nucleotides in length. In some instances, the second polynucleotide is from about 10 to about 50 nucleotides in length. In some instances, the second polynucleotide is from about 10 to about 45 nucleotides in length. In some instances, the second polynucleotide is from about 10 to about 40 nucleotides in length. In some instances, the second polynucleotide is from about 10 to about 35 nucleotides in length. In some instances, the second polynucleotide is from about 10 to about 30 nucleotides in length. In some instances, the second polynucleotide is from about 10 to about 25 nucleotides in length. In some instances, the second polynucleotide is from about 10 to about 20 nucleotides in length. In some instances, the second polynucleotide is from about 15 to about 25 nucleotides in length. In some instances, the second polynucleotide is from about 15 to about 30 nucleotides in length. In some instances, the second polynucleotide is from about 12 to about 30 nucleotides in length.

In some embodiments, the polynucleic acid molecule comprises a first polynucleotide and a second polynucleotide. In some instances, the polynucleic acid molecule further comprises a blunt terminus, an overhang, or a combination thereof. In some instances, the blunt terminus is a 5' blunt terminus, a 3' blunt terminus, or both. In some cases, the overhang is a 5' overhang, 3' overhang, or both. In some cases, the overhang comprises 1, 2, 3, 4, 5, 6, 7, 8, 9, or 10 non-base pairing nucleotides. In some cases, the overhang comprises 1, 2, 3, 4, 5, or 6 non-base pairing nucleotides. In some cases, the overhang comprises 1, 2, 3, or 4 non-base pairing nucleotides. In some cases, the overhang comprises 1 non-base pairing nucleotide. In some cases, the overhang comprises 2 non-base pairing nucleotides. In some cases, the overhang comprises 3 non-base pairing nucleotides. In some cases, the overhang comprises 4 non-base pairing nucleotides.

In some embodiments, the sequence of the polynucleic acid molecule is at least 40%, 50%, 55%, 60%, 65%, 70%, 75%, 80%, 85%, 90%, 95%, 98%, 99%, or 99.5% complementary to a target sequence described herein. In some embodiments, the sequence of the polynucleic acid molecule is at least 50% complementary to a target sequence described herein. In some embodiments, the sequence of the polynucleic acid molecule is at least 60% complementary to a target sequence described herein. In some embodiments, the sequence of the polynucleic acid molecule is at least 70% complementary to a target sequence described herein. In some embodiments, the sequence of the polynucleic acid molecule is at least 80% complementary to a target sequence described herein. In some embodiments, the sequence of the polynucleic acid molecule is at least 90% complementary to a target sequence described herein. In some embodiments, the sequence of the polynucleic acid molecule is at least 95% complementary to a target sequence described herein. In some embodiments, the sequence of the polynucleic acid molecule is at least 99% complementary to a target sequence described herein. In some instances, the sequence of the polynucleic acid molecule is 100% complementary to a target sequence described herein.

In some embodiments, the sequence of the polynucleic acid molecule has 5 or less mismatches to a target sequence described herein. In some embodiments, the sequence of the polynucleic acid molecule has 4 or less mismatches to a target sequence described herein. In some instances, the sequence of the polynucleic acid molecule may has 3 or less mismatches to a target sequence described herein. In some cases, the sequence of the polynucleic acid molecule may has 2 or less mismatches to a target sequence described herein. In some cases, the sequence of the polynucleic acid molecule may has 1 or less mismatches to a target sequence described herein.

In some embodiments, the specificity of the polynucleic acid molecule that hybridizes to a target sequence described herein is a 95%, 98%, 99%, 99.5%, or 100% sequence complementarity of the polynucleic acid molecule to a target sequence. In some instances, the hybridization is a high stringent hybridization condition.

In some embodiments, the polynucleic acid molecule hybridizes to at least 8, 9, 10, 11, 12, 13, 14, 15, 16, 17, 18, 19, 20, or more contiguous bases of a target sequence described herein. In some embodiments, the polynucleic acid molecule hybridizes to at least 8 contiguous bases of a target sequence described herein. In some embodiments, the polynucleic acid molecule hybridizes to at least 9 contiguous bases of a target sequence described herein. In some embodiments, the polynucleic acid molecule hybridizes to at least 10 contiguous bases of a target sequence described herein. In some embodiments, the polynucleic acid molecule hybridizes to at least 11 contiguous bases of a target sequence described herein. In some embodiments, the polynucleic acid molecule hybridizes to at least 12 contiguous bases of a target sequence described herein. In some embodiments, the polynucleic acid molecule hybridizes to at least 13 contiguous bases of a target sequence described herein. In some embodiments, the polynucleic acid molecule hybridizes to at least 14 contiguous bases of a target sequence described herein. In some embodiments, the polynucleic acid molecule hybridizes to at least 15 contiguous bases of a target sequence described herein. In some embodiments, the polynucleic acid molecule hybridizes to at least 16 contiguous bases of a target sequence described herein. In some embodiments, the polynucleic acid molecule hybridizes to at least 17 contiguous bases of a target sequence described herein. In some embodiments, the polynucleic acid molecule hybridizes to at least 18 contiguous bases of a target sequence described herein. In some embodiments, the polynucleic acid molecule hybridizes to at least 19 contiguous bases of a target sequence described herein. In some embodiments, the polynucleic acid molecule hybridizes to at least 20 contiguous bases of a target sequence described herein.

In some embodiments, the polynucleic acid molecule has reduced off-target effect. In some instances, "off-target" or "off-target effects" refer to any instance in which a polynucleic acid polymer directed against a given target causes an unintended effect by interacting either directly or indirectly with another mRNA sequence, a DNA sequence or a cellular protein or other moiety. In some instances, an "off-target effect" occurs when there is a simultaneous degradation of other transcripts due to partial homology or complementarity between that other transcript and the sense and/or antisense strand of the polynucleic acid molecule.

In some embodiments, the polynucleic acid molecule comprises natural, synthetic, or artificial nucleotide analogues or bases. In some cases, the polynucleic acid molecule comprises combinations of DNA, RNA and/or nucleotide analogues. In some instances, the synthetic or artificial nucleotide analogues or bases comprise modifications at one or more of ribose moiety, phosphate moiety, nucleoside moiety, or a combination thereof.

In some embodiments, a nucleotide analogue or artificial nucleotide base described above comprises a nucleic acid with a modification at a 2' hydroxyl group of the ribose moiety. In some instances, the modification includes an H, OR, R, halo, SH, SR, NH2, NHR, NR2, or CN, wherein R is an alkyl moiety. Exemplary alkyl moiety includes, but is not limited to, halogens, sulfurs, thiols, thioethers, thioesters, amines (primary, secondary, or tertiary), amides, ethers, esters, alcohols and oxygen. In some instances, the alkyl moiety further comprises a modification. In some instances, the modification comprises an azo group, a keto group, an aldehyde group, a carboxyl group, a nitro group, a nitroso, group, a nitrile group, a heterocycle (e.g., imidazole, hydrazino or hydroxylamino) group, an isocyanate or cyanate group, or a sulfur containing group (e.g., sulfoxide, sulfone, sulfide, or disulfide). In some instances, the alkyl moiety further comprises a hetero substitution. In some instances, the carbon of the heterocyclic group is substituted by a nitrogen, oxygen or sulfur. In some instances, the heterocyclic substitution includes but is not limited to, morpholino, imidazole, and pyrrolidino.

In some instances, the modification at the 2' hydroxyl group is a 2'-O-methyl modification or a 2'-O-methoxyethyl (2'-O-MOE) modification. In some cases, the 2'-O-methyl modification adds a methyl group to the 2' hydroxyl group of the ribose moiety whereas the 2'O-methoxyethyl modification adds a methoxyethyl group to the 2' hydroxyl group of the ribose moiety. Exemplary chemical structures of a 2'-O-methyl modification of an adenosine molecule and 2'O-methoxyethyl modification of an uridine are illustrated below.

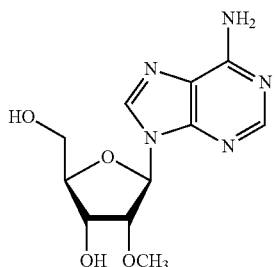

2'-O-methyl-adenosine

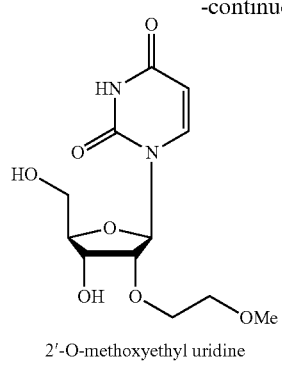

2'-O-methoxyethyl uridine

In some instances, the modification at the 2' hydroxyl group is a 2'-O-aminopropyl modification in which an extended amine group comprising a propyl linker binds the amine group to the 2' oxygen. In some instances, this modification neutralizes the phosphate-derived overall negative charge of the oligonucleotide molecule by introducing one positive charge from the amine group per sugar and thereby improves cellular uptake properties due to its zwitterionic properties. An exemplary chemical structure of a 2'-O-aminopropyl nucleoside phosphoramidite is illustrated below.

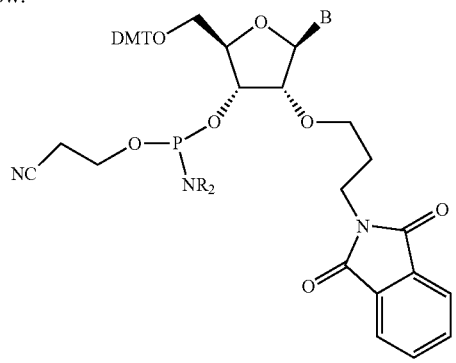

2'-O-aminopropyl nucleoside phosphoramidite

In some instances, the modification at the 2' hydroxyl group is a locked or bridged ribose modification (e.g., locked nucleic acid or LNA) in which the oxygen molecule bound at the 2' carbon is linked to the 4' carbon by a methylene group, thus forming a 2'-C,4'-C-oxy-methylene-linked bicyclic ribonucleotide monomer. Exemplary representations of the chemical structure of LNA are illustrated below. The representation shown to the left highlights the chemical connectivities of an LNA monomer. The representation shown to the right highlights the locked 3'-endo ($^3$E) conformation of the furanose ring of an LNA monomer.

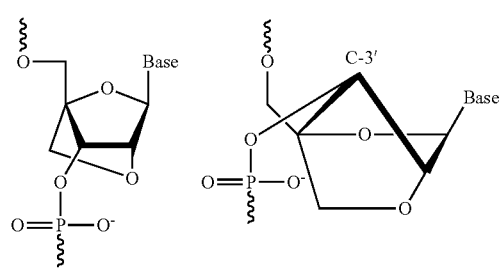

LNA (Locked Nucleic Acids)

In some instances, the modification at the 2' hydroxyl group comprises ethylene nucleic acids (ENA) such as for example 2'-4'-ethylene-bridged nucleic acid, which locks the sugar conformation into a $C_3$'-endo sugar puckering conformation. ENA are part of the bridged nucleic acids class of modified nucleic acids that also comprises LNA. Exemplary chemical structures of the ENA and bridged nucleic acids are illustrated below.

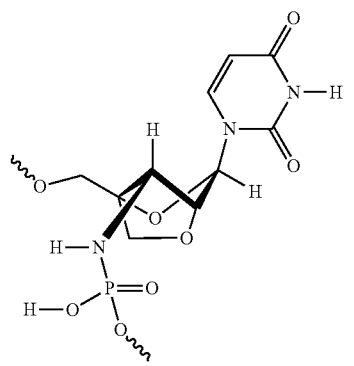

3'-amino-2',4'-BNA

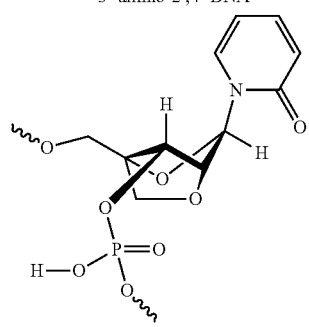

2',4'-BNA-2-pyridine

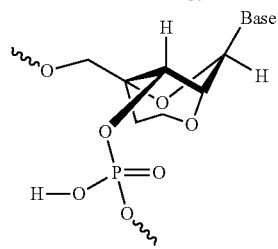

2',4'-ENA

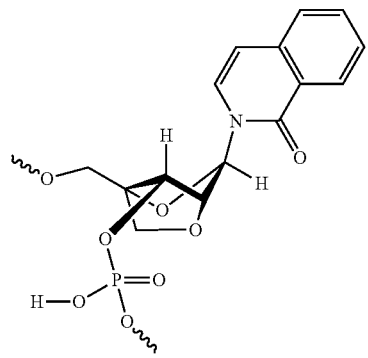

2',4'-BNA-1-isoquinolone

In some embodiments, additional modifications at the 2' hydroxyl group include 2'-deoxy, T-deoxy-2'-fluoro, 2'-O-aminopropyl (2'-O-AP), 2'-O-dimethylaminoethyl (2'-O-DMAOE), 2'-O-dimethylaminopropyl (2'-O-DMAP), T-O-dimethylaminoethyloxyethyl (2'-O-DMAEOE), or 2'-O—N-methylacetamido (2'-O-NMA).

In some embodiments, a nucleotide analogue comprises a modified base such as, but not limited to, 5-propynyluridine, 5-propynylcytidine, 6-methyladenine, 6-methylguanine, N, N, -dimethyladenine, 2-propyladenine, 2propylguanine, 2-aminoadenine, 1-methyl inosine, 3-methyluridine, 5-methylcytidine, 5-methyluridine and other nucleotides having a modification at the 5 position, 5-(2-amino) propyl uridine, 5-halocytidine, 5-halouridine, 4-acetylcytidine, 1-methyladenosine, 2-methyladenosine, 3-methylcytidine, 6-methyluridine, 2-methylguanosine, 7-methylguanosine, 2, 2-dimethylguanosine, 5-methylaminoethyluridine, 5-methyloxyuridine, deazanucleotides (such as 7-deaza-adenosine, 6-azouridine, 6-azocytidine, or 6-azothymidine), 5-methyl-2-thiouridine, other thio bases (such as 2-thiouridine, 4-thiouridine, and 2-thiocytidine), dihydrouridine, pseudouridine, queuosine, archaeosine, naphthyl and substituted naphthyl groups, any O- and N-alkylated purines and pyrimidines (such as N6-methyladenosine, 5-methylcarbonylmethyluridine, uridine 5-oxyacetic acid, pyridine-4-one, or pyridine-2-one), phenyl and modified phenyl groups such as aminophenol or 2,4,6-trimethoxy benzene, modified cytosines that act as G-clamp nucleotides, 8-substituted adenines and guanines, 5-substituted uracils and thymines, azapyrimidines, carboxyhydroxyalkyl nucleotides, carboxyalkylaminoalkyl nucleotides, and alkylcarbonylalkylated nucleotides. Modified nucleotides also include those nucleotides that are modified with respect to the sugar moiety, as well as nucleotides having sugars or analogs thereof that are not ribosyl. For example, the sugar moieties, in some cases are or are based on, mannoses, arabinoses, glucopyranoses, galactopyranoses, 4'-thioribose, and other sugars, heterocycles, or carbocycles. The term nucleotide also includes what are known in the art as universal bases. By way of example, universal bases include but are not limited to 3-nitropyrrole, 5-nitroindole, or nebularine.

In some embodiments, a nucleotide analogue further comprises a morpholino, a peptide nucleic acid (PNA), a methylphosphonate nucleotide, a thiolphosphonate nucleotide, a 2'-fluoro N3-P5'-phosphoramidite, or a 1', 5'-anhydrohexitol nucleic acid (HNA). Morpholino or phosphorodiamidate morpholino oligo (PMO) comprises synthetic molecules whose structure mimics natural nucleic acid structure but deviates from the normal sugar and phosphate structures. In some instances, the five member ribose ring is substituted with a six member morpholino ring containing four carbons, one nitrogen, and one oxygen. In some cases, the ribose monomers are linked by a phosphordiamidate group instead of a phosphate group. In such cases, the backbone alterations remove all positive and negative charges making morpholinos neutral molecules capable of crossing cellular membranes without the aid of cellular delivery agents such as those used by charged oligonucleotides.

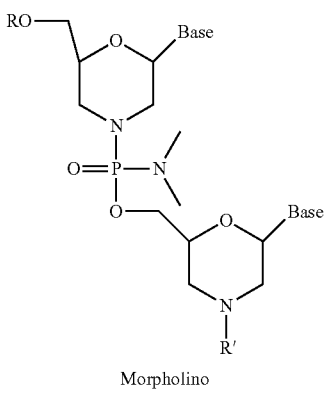

Morpholino

In some embodiments, a morpholino or PMO described above is a PMO comprising a positive or cationic charge. In some instances, the PMO is PMOplus (Sarepta). PMOplus refers to phosphorodiamidate morpholino oligomers comprising any number of (1-piperazino)phosphinylideneoxy, (1-(4-(omega-guanidino-alkanoyl))-piperazino)phosphinylideneoxy linkages (e.g., as such those described in PCT Publication No. WO2008/036127. In some cases, the PMO is a PMO described in U.S. Pat. No. 7,943,762.

In some embodiments, a morpholino or PMO described above is a PMO-X (Sarepta). In some cases, PMO-X refers to phosphorodiamidate morpholino oligomers comprising at least one linkage or at least one of the disclosed terminal modifications, such as those disclosed in PCT Publication No. WO2011/150408 and U.S. Publication No. 2012/0065169.

In some embodiments, a morpholino or PMO described above is a PMO as described in Table 5 of U.S. Publication No. 2014/0296321.

In some embodiments, peptide nucleic acid (PNA) does not contain sugar ring or phosphate linkage and the bases are attached and appropriately spaced by oligoglycine-like molecules, therefore, eliminating a backbone charge.

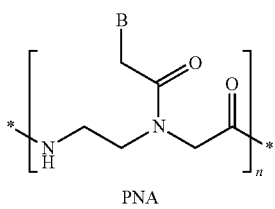

PNA

In some embodiments, one or more modifications optionally occur at the internucleotide linkage. In some instances, modified internucleotide linkage includes, but is not limited to, phosphorothioates; phosphorodithioates; methylphosphonates; 5'-alkylenephosphonates; 5'-methylphosphonate; 3'-alkylene phosphonates; borontrifluoridates; borano phosphate esters and selenophosphates of 3'-5'linkage or 2'-5'linkage; phosphotriesters; thionoalkylphosphotriesters; hydrogen phosphonate linkages; alkyl phosphonates; alkylphosphonothioates; arylphosphonothioates; phosphoroselenoates; phosphorodiselenoates; phosphinates; phosphoramidates; 3'-alkylphosphoramidates; aminoalkylphosphoramidates; thionophosphoramidates; phosphoropiperazidates; phosphoroanilothioates; phosphoroanilidates; ketones; sulfones; sulfonamides; carbonates; carbamates; methylenehydrazos; methylenedimethylhydrazos; formacetals; thioformacetals; oximes; methyleneiminos; methylenemethyliminos; thioamidates; linkages with riboacetyl groups; aminoethyl glycine; silyl or siloxane linkages; alkyl or cycloalkyl linkages with or without heteroatoms of, for example, 1 to 10 carbons that are saturated or unsaturated and/or substituted and/or contain heteroatoms; linkages with morpholino structures, amides, or polyamides wherein the bases are attached to the aza nitrogens of the backbone directly or indirectly; and combinations thereof.

In some instances, the modification is a methyl or thiol modification such as methylphosphonate or thiolphosphonate modification. Exemplary thiolphosphonate nucleotide (left) and methylphosphonate nucleotide (right) are illustrated below.

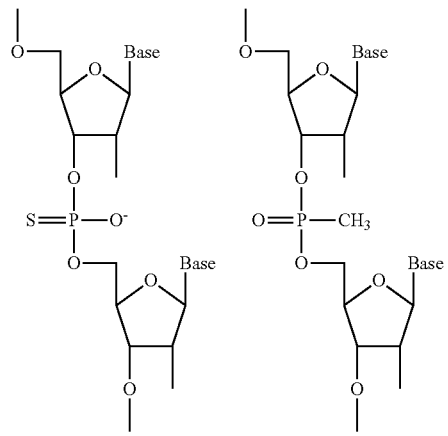

In some instances, a modified nucleotide includes, but is not limited to, 2'-fluoro N3-P5'-phosphoramidites illustrated as:

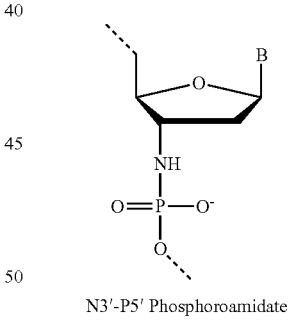

N3'-P5' Phosphoroamidate

In some instances, a modified nucleotide includes, but is not limited to, hexitol nucleic acid (or 1',5'-anhydrohexitol nucleic acids (HNA)) illustrated as:

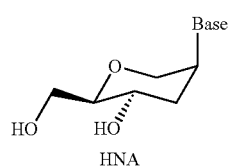

HNA

In some embodiments, one or more modifications comprise a modified phosphate backbone in which the modification generates a neutral or uncharged backbone. In some instances, the phosphate backbone is modified by alkylation to generate an uncharged or neutral phosphate backbone. As used herein, alkylation includes methylation, ethylation, and propylation. In some cases, an alkyl group, as used herein in the context of alkylation, refers to a linear or branched saturated hydrocarbon group containing from 1 to 6 carbon atoms. In some instances, exemplary alkyl groups include, but are not limited to, methyl, ethyl, n-propyl, isopropyl, n-butyl, isobutyl, sec-butyl, tert-butyl, n-pentyl, isopentyl, neopentyl, hexyl, isohexyl, 1, 1-dimethylbutyl, 2,2-dimethylbutyl, 3,3-dimethylbutyl, and 2-ethylbutyl groups. In some cases, a modified phosphate is a phosphate group as described in U.S. Pat. No. 9,481,905.

In some embodiments, additional modified phosphate backbones comprise methylphosphonate, ethylphosphonate, methylthiophosphonate, or methoxyphosphonate. In some cases, the modified phosphate is methylphosphonate. In some cases, the modified phosphate is ethylphosphonate. In some cases, the modified phosphate is methylthiophosphonate. In some cases, the modified phosphate is methoxyphosphonate.

In some embodiments, one or more modifications further optionally include modifications of the ribose moiety, phosphate backbone and the nucleoside, or modifications of the nucleotide analogues at the 3' or the 5' terminus. For example, the 3' terminus optionally include a 3' cationic group, or by inverting the nucleoside at the 3'-terminus with a 3'-3' linkage. In another alternative, the 3'-terminus is optionally conjugated with an aminoalkyl group, e.g., a 3' C5-aminoalkyl dT. In an additional alternative, the 3'-terminus is optionally conjugated with an abasic site, e.g., with an apurinic or apyrimidinic site. In some instances, the 5'-terminus is conjugated with an aminoalkyl group, e.g., a 5'-O-alkylamino substituent. In some cases, the 5'-terminus is conjugated with an abasic site, e.g., with an apurinic or apyrimidinic site.

In some embodiments, the polynucleic acid molecule comprises one or more of the artificial nucleotide analogues described herein. In some instances, the polynucleic acid molecule comprises 1, 2, 3, 4, 5, 6, 7, 8, 9, 10, 11, 12, 13, 14, 15, 16, 17, 18, 20, 25, or more of the artificial nucleotide analogues described herein. In some embodiments, the artificial nucleotide analogues include 2'-O-methyl, 2'-O-methoxyethyl (2'-O-MOE), 2 '-O-aminopropyl, 2'-deoxy, T-deoxy-2'-fluoro, 2'-O-aminopropyl (2'-O-AP), 2'-O-dimethylaminoethyl (2'-O-DMAOE), 2'-O-dimethylaminopropyl (2'-O-DMAP), T-O-dimethylaminoethyloxyethyl (2'-O-DMAEOE), or 2'-O—N-methylacetamido (2'-O-NMA) modified, LNA, ENA, PNA, HNA, morpholino, methylphosphonate nucleotides, thiolphosphonate nucleotides, 2'-fluoro N3-P5'-phosphoramidites, or a combination thereof. In some instances, the polynucleic acid molecule comprises 1, 2, 3, 4, 5, 6, 7, 8, 9, 10, 11, 12, 13, 14, 15, 16, 17, 18, 20, 25, or more of the artificial nucleotide analogues selected from 2'-O-methyl, 2'-O-methoxyethyl (2'-O-MOE), 2'-O-aminopropyl, 2'-deoxy, T-deoxy-2'-fluoro, 2'-O-aminopropyl (2'-O-AP), 2'-O-dimethylaminoethyl (2'-O-DMAOE), 2'-O-dimethylaminopropyl (2'-O-DMAP), T-O-dimethylaminoethyloxyethyl (2'-O-DMAEOE), or 2'-O—N-methylacetamido (2'-O-NMA) modified, LNA, ENA, PNA, HNA, morpholino, methylphosphonate nucleotides, thiolphosphonate nucleotides, 2'-fluoro N3-P5'-phosphoramidites, or a combination thereof. In some instances, the polynucleic acid molecule comprises 1, 2, 3, 4, 5, 6, 7, 8, 9, 10, 11, 12, 13, 14, 15, 16, 17, 18, 20, 25, or more of 2'-O-methyl modified nucleotides. In some instances, the polynucleic acid molecule comprises 1, 2, 3, 4, 5, 6, 7, 8, 9, 10, 11, 12, 13, 14, 15, 16, 17, 18, 20, 25, or more of 2'-O-methoxyethyl (2'-O-MOE) modified nucleotides. In some instances, the polynucleic acid molecule comprises 1, 2, 3, 4, 5, 6, 7, 8, 9, 10, 11, 12, 13, 14, 15, 16, 17, 18, 20, 25, or more of thiolphosphonate nucleotides.

In some embodiments, the polynucleic acid molecule comprises at least about 1, about 2, about 3, about 4, about 5, about 6, about 7, about 8, about 9, about 10, about 11, about 12, about 13, about 14, about 15, about 16, about 17, about 18, about 19, about 20, about 21, about 22, or more modifications. In some instances, the polynucleic acid molecule is a polynucleic acid molecule of SEQ ID NOs: 16-75, 452-1955, 1956-1962, 1967-2002, 2013-2032, 2082-2109, or 2117.

In some instances, the polynucleic acid molecule comprises at least about 1, about 2, about 3, about 4, about 5, about 6, about 7, about 8, about 9, about 10, about 11, about 12, about 13, about 14, about 15, about 16, about 17, about 18, about 19, about 20, about 21, about 22, or more modified nucleotides. In some instances, the polynucleic acid molecule is a polynucleic acid molecule of SEQ ID NOs: 16-75, 452-1955, 1956-1962, 1967-2002, 2013-2032, 2082-2109, or 2117.

In some instances, the polynucleic acid molecule comprises at least one of: from about 5% to about 100% modification, from about 10% to about 100% modification, from about 20% to about 100% modification, from about 30% to about 100% modification, from about 40% to about 100% modification, from about 50% to about 100% modification, from about 60% to about 100% modification, from about 70% to about 100% modification, from about 80% to about 100% modification, and from about 90% to about 100% modification. In some instances, the polynucleic acid molecule is a polynucleic acid molecule of SEQ ID NOs: 16-75, 452-1955, 1956-1962, 1967-2002, 2013-2032, 2082-2109, or 2117.

In some instances, about 5 to about 100% of the polynucleic acid molecule comprise the artificial nucleotide analogues described herein. In some instances, about 5%, 10%, 15%, 20%, 25%, 30%, 35%, 40%, 45%, 50%, 55%, 60%, 65%, 70%, 75%, 80%, 85%, 90%, 95%, or 100% of the polynucleic acid molecule comprise the artificial nucleotide analogues described herein. In some instances, about 5%, 10%, 15%, 20%, 25%, 30%, 35%, 40%, 45%, 50%, 55%, 60%, 65%, 70%, 75%, 80%, 85%, 90%, 95%, or 100% of a polynucleic acid molecule of SEQ ID NOs: 16-75, 452-1955, 1956-1962, 1967-2002, 2013-2032, 2082-2109, or 2117 comprise the artificial nucleotide analogues described herein. In some instances, about 5%, 10%, 15%, 20%, 25%, 30%, 35%, 40%, 45%, 50%, 55%, 60%, 65%, 70%, 75%, 80%, 85%, 90%, 95%, or 100% of a polynucleic acid molecule of SEQ ID NOs: 16-45 comprise the artificial nucleotide analogues described herein. In some instances, about 5%, 10%, 15%, 20%, 25%, 30%, 35%, 40%, 45%, 50%, 55%, 60%, 65%, 70%, 75%, 80%, 85%, 90%, 95%, or 100% of a polynucleic acid molecule of SEQ ID NOs: 452-1203 comprise the artificial nucleotide analogues described herein. In some instances, about 5%, 10%, 15%, 20%, 25%, 30%, 35%, 40%, 45%, 50%, 55%, 60%, 65%, 70%, 75%, 80%, 85%, 90%, 95%, or 100% of a polynucleic acid molecule of SEQ ID NOs: 1956-1962 comprise the artificial nucleotide analogues described herein. In some instances, about 5%, 10%, 15%, 20%, 25%, 30%, 35%, 40%, 45%, 50%, 55%, 60%, 65%, 70%, 75%, 80%, 85%, 90%, 95%, or 100% of a polynucleic acid molecule of SEQ ID NOs: 1967-2002 comprise the artificial nucleotide analogues described herein. In some instances, about 5%, 10%, 15%, 20%, 25%, 30%, 35%, 40%, 45%, 50%, 55%, 60%, 65%, 70%, 75%, 80%, 85%, 90%, 95%, or 100% of a polynucleic acid molecule of SEQ ID NOs: 2013-2032 comprise the artificial nucleotide analogues described herein. In some instances, about 5%, 10%, 15%, 20%, 25%, 30%, 35%, 40%, 45%, 50%, 55%, 60%, 65%, 70%, 75%, 80%, 85%, 90%, 95%, or 100% of a polynucleic acid molecule of SEQ ID NOs: 2082-2109 or 2117 comprise the artificial nucleotide analogues described herein. In some embodiments, the artificial nucleotide analogues include 2'-O-methyl, 2'-O-methoxyethyl (2'-O-MOE), 2'-O-aminopropyl, 2'-deoxy, T-deoxy-2'-fluoro, 2'-O-aminopropyl (2'-O-AP), 2'-O-dimethylaminoethyl (2'-O-DMAOE), 2'-O-dimethylaminopropyl (2'-O-DMAP), T-O-dimethylaminoethyloxyethyl (2'-O-DMAEOE), or 2'-O—N-methylacetamido (2'-O-NMA) modified, LNA, ENA, PNA, HNA, morpholino, methylphosphonate nucleotides, thiolphosphonate nucleotides, 2'-fluoro N3-P5'-phosphoramidites, or a combination thereof.

In some instances, the polynucleic acid molecule that comprises an artificial nucleotide analogue comprises SEQ ID NOs: 46-75. In some instances, the polynucleic acid molecule that comprises an artificial nucleotide analogue comprises SEQ ID NOs: 1204-1955. In some instances, the polynucleic acid molecule that comprises an artificial nucleotide analogue comprises SEQ ID NOs: 1967-2002. In some instances, the polynucleic acid molecule that comprises an artificial nucleotide analogue comprises SEQ ID NOs: 2013-2032. In some instances, the polynucleic acid molecule that comprises an artificial nucleotide analogue comprises SEQ ID NOs: 2082-2109 or 2117.

In some cases, one or more of the artificial nucleotide analogues described herein are resistant toward nucleases such as for example ribonuclease such as RNase H, deoxyribunuclease such as DNase, or exonuclease such as 5'-3' exonuclease and 3'-5' exonuclease when compared to natural polynucleic acid molecules. In some instances, artificial nucleotide analogues comprising 2'-O-methyl, 2'-O-methoxyethyl (2'-O-MOE), 2'-O-aminopropyl, 2'-deoxy, T-deoxy-2'-fluoro, 2'-O-aminopropyl (2'-O-AP), 2'-O-dimethylaminoethyl (2'-O-DMAOE), 2'-O-dimethylaminopropyl (2'-O-DMAP), T-O-dimethylaminoethyloxyethyl (2'-O-DMAEOE), or 2'-O—N-methylacetamido (2'-O-NMA) modified, LNA, ENA, PNA, HNA, morpholino, methylphosphonate nucleotides, thiolphosphonate nucleotides, 2'-fluoro N3-P5'-phosphoramidites, or combinations thereof are resistant toward nucleases such as for example ribonuclease such as RNase H, deoxyribunuclease such as DNase, or exonuclease such as 5'-3' exonuclease and 3'-5' exonuclease. In some instances, 2'-O-methyl modified polynucleic acid molecule is nuclease resistant (e.g., RNase H, DNase, 5'-3' exonuclease or 3'-5' exonuclease resistant). In some instances, 2'O-methoxyethyl (2'-O-MOE) modified polynucleic acid molecule is nuclease resistant (e.g., RNase H, DNase, 5'-3' exonuclease or 3'-5' exonuclease resistant). In some instances, 2'-O-aminopropyl modified polynucleic acid molecule is nuclease resistant (e.g., RNase H, DNase, 5'-3' exonuclease or 3'-5' exonuclease resistant). In some instances, 2'-deoxy modified polynucleic acid molecule is nuclease resistant (e.g., RNase H, DNase, 5'-3' exonuclease or 3'-5' exonuclease resistant). In some instances, T-deoxy-2'-fluoro modified polynucleic acid molecule is nuclease resistant (e.g., RNase H, DNase, 5'-3' exonuclease or 3'-5' exonuclease resistant). In some instances, 2'-O-aminopropyl (2'-O-AP) modified polynucleic acid molecule is nuclease resistant (e.g., RNase H, DNase, 5'-3' exonuclease or 3'-5' exonuclease resistant). In some instances, 2'-O-dimethylaminoethyl (2'-O-DMAOE) modified polynucleic acid molecule is nuclease resistant (e.g., RNase H, DNase, 5'-3' exonuclease or 3'-5' exonuclease resistant). In some instances, 2'-O-dimethylaminopropyl (2'-O-DMAP) modified polynucleic acid molecule is nuclease resistant (e.g., RNase H, DNase, 5'-3' exonuclease or 3'-5' exonuclease resistant). In some instances, T-O— dimethylaminoethyloxyethyl (2'-O-DMAEOE) modified polynucleic acid molecule is nuclease resistant (e.g., RNase H, DNase, 5'-3' exonuclease or 3'-5' exonuclease resistant). In some instances, 2'-O—N-methylacetamido (2'-O-NMA) modified polynucleic acid molecule is nuclease resistant (e.g., RNase H, DNase, 5'-3' exonuclease or 3'-5' exonuclease resistant). In some instances, LNA-modified polynucleic acid molecule is nuclease resistant (e.g., RNase H, DNase, 5'-3' exonuclease or 3'-5' exonuclease resistant). In some instances, ENA-modified polynucleic acid molecule is nuclease resistant (e.g., RNase H, DNase, 5'-3' exonuclease or 3'-5' exonuclease resistant). In some instances, HNA-modified polynucleic acid molecule is nuclease resistant (e.g., RNase H, DNase, 5'-3' exonuclease or 3'-5' exonuclease resistant). Morpholinos may be nuclease resistant (e.g., RNase H, DNase, 5'-3' exonuclease or 3'-5' exonuclease resistant). In some instances, PNA-modified polynucleic acid molecule is resistant to nucleases (e.g., RNase H, DNase, 5'-3' exonuclease or 3'-5' exonuclease resistant). In some instances, methylphosphonate nucleotide-modified polynucleic acid molecule is nuclease resistant (e.g., RNase H, DNase, 5'-3' exonuclease or 3'-5' exonuclease resistant). In some instances, thiolphosphonate nucleotide-modified polynucleic acid molecule is nuclease resistant (e.g., RNase H, DNase, 5'-3' exonuclease or 3'-5' exonuclease resistant). In some instances, polynucleic acid molecule comprising 2'-fluoro N3-P5'-phosphoramidites is nuclease resistant (e.g., RNase H, DNase, 5'-3' exonuclease or 3'-5' exonuclease resistant). In some instances, the 5' conjugates described herein inhibit 5'-3' exonucleolytic cleavage. In some instances, the 3' conjugates described herein inhibit 3'-5' exonucleolytic cleavage.

In some embodiments, one or more of the artificial nucleotide analogues described herein have increased binding affinity toward their mRNA target relative to an equivalent natural polynucleic acid molecule. The one or more of the artificial nucleotide analogues comprising 2'-O-methyl, 2'-O-methoxyethyl (2'-O-MOE), 2'-O-aminopropyl, 2'-deoxy, T-deoxy-2'-fluoro, 2'-O-aminopropyl (2'-O-AP), 2'-O-dimethylaminoethyl (2'-O-DMAOE), 2'-O-dimethylaminopropyl (2'-O-DMAP), T-O-dimethylaminoethyloxyethyl (2'-O-DMAEOE), or 2'-O—N-methylacetamido (2'-O-NMA) modified, LNA, ENA, PNA, HNA, morpholino, methylphosphonate nucleotides, thiolphosphonate nucleotides, or 2'-fluoro N3-P5'-phosphoramidites can have increased binding affinity toward their mRNA target relative to an equivalent natural polynucleic acid molecule. In some instances, 2'-O-methyl modified polynucleic acid molecule has increased binding affinity toward their mRNA target relative to an equivalent natural polynucleic acid molecule. In some instances, 2'-O-methoxyethyl (2'-O-MOE) modified polynucleic acid molecule has increased binding affinity toward their mRNA target relative to an equivalent natural polynucleic acid molecule. In some instances, 2'-O-aminopropyl modified polynucleic acid molecule has increased binding affinity toward their mRNA target relative to an equivalent natural polynucleic acid molecule. In some instances, 2'-deoxy modified polynucleic acid molecule has increased binding affinity toward their mRNA target relative to an equivalent natural polynucleic acid molecule. In some instances, T-deoxy-2'-fluoro modified polynucleic acid molecule has increased binding affinity toward their mRNA target relative to an equivalent natural polynucleic acid molecule. In some instances, 2'-O-aminopropyl (2'-O-AP) modified polynucleic acid molecule has increased binding affinity toward their mRNA target relative to an equivalent natural polynucleic acid molecule. In some instances, 2'-O-dimethylaminoethyl (2'-O-DMAOE) modified polynucleic acid molecule has increased binding affinity toward their mRNA target relative to an equivalent natural polynucleic acid molecule. In some instances, 2'-O-dimethylaminopropyl (2'-O-DMAP) modified polynucleic acid molecule has increased binding affinity toward their mRNA target relative to an equivalent natural polynucleic acid molecule. In some instances, T-O-dimethylaminoethyloxyethyl (2'-O-DMAEOE) modified polynucleic acid molecule has increased binding affinity toward their mRNA target relative to an equivalent natural polynucleic acid molecule. In some instances, 2'-O—N-methylacetamido (2'-O-NMA) modified polynucleic acid molecule has increased binding affinity toward their mRNA target relative to an equivalent natural polynucleic acid molecule. In some instances, LNA-modified polynucleic acid molecule has increased binding affinity toward their mRNA target relative to an equivalent natural polynucleic acid molecule. In some instances, ENA-modified polynucleic acid molecule has increased binding affinity toward their mRNA target relative to an equivalent natural polynucleic acid molecule. In some instances, PNA-modified polynucleic acid molecule has increased binding affinity toward their mRNA target relative to an equivalent natural polynucleic acid molecule. In some instances, HNA-modified polynucleic acid molecule has increased binding affinity toward their mRNA target relative to an equivalent natural polynucleic acid molecule. In some instances, morpholino-modified polynucleic acid molecule has increased binding affinity toward their mRNA target relative to an equivalent natural polynucleic acid molecule. In some instances, methylphosphonate nucleotide-modified polynucleic acid molecule has increased binding affinity toward their mRNA target relative to an equivalent natural polynucleic acid molecule. In some instances, thiolphosphonate nucleotide-modified polynucleic acid molecule has increased binding affinity toward their mRNA target relative to an equivalent natural polynucleic acid molecule. In some instances, polynucleic acid molecule comprising 2'-fluoro N3-P5'-phosphoramidites has increased binding affinity toward their mRNA target relative to an equivalent natural polynucleic acid molecule. In some cases, the increased affinity is illustrated with a lower Kd, a higher melt temperature (Tm), or a combination thereof.

In some embodiments, a polynucleic acid molecule described herein is a chirally pure (or stereo pure) polynucleic acid molecule, or a polynucleic acid molecule comprising a single enantiomer. In some instances, the polynucleic acid molecule comprises L-nucleotide. In some instances, the polynucleic acid molecule comprises D-nucleotides. In some instance, a polynucleic acid molecule composition comprises less than 30%, 25%, 20%, 15%, 10%, 5%, 4%, 3%, 2%, 1%, or less of its mirror enantiomer. In some cases, a polynucleic acid molecule composition comprises less than 30%, 25%, 20%, 15%, 10%, 5%, 4%, 3%, 2%, 1%, or less of a racemic mixture. In some instances, the polynucleic acid molecule is a polynucleic acid molecule described in: U.S. Patent Publication Nos: 2014/194610 and 2015/211006; and PCT Publication No.: WO2015107425.

In some embodiments, a polynucleic acid molecule described herein is further modified to include an aptamer-conjugating moiety. In some instances, the aptamer conjugating moiety is a DNA aptamer-conjugating moiety. In some instances, the aptamer-conjugating moiety is Alphamer (Centauri Therapeutics), which comprises an aptamer portion that recognizes a specific cell-surface target and a portion that presents a specific epitopes for attaching to circulating antibodies. In some instance, a polynucleic acid molecule described herein is further modified to include an aptamer-conjugating moiety as described in: U.S. Pat. Nos. 8,604,184, 8,591,910, and 7,850,975.

In additional embodiments, a polynucleic acid molecule described herein is modified to increase its stability. In some embodiment, the polynucleic acid molecule is RNA (e.g., siRNA), the polynucleic acid molecule is modified to increase its stability. In some instances, the polynucleic acid molecule is modified by one or more of the modifications described above to increase its stability. In some cases, the polynucleic acid molecule is modified at the 2' hydroxyl position, such as by 2'-O-methyl, 2'-O-methoxyethyl (2'-O-MOE), 2'-O-aminopropyl, 2'-deoxy, T-deoxy-2'-fluoro, 2'-O-aminopropyl (2'-0-AP), 2'-O-dimethylaminoethyl (2'-O-DMAOE), 2'-O-dimethylaminopropyl (2'-O-DMAP), T-O-dimethylaminoethyloxyethyl (2'-O-DMAEOE), or 2'-O—N-methylacetamido (2'-O-NMA) modification or by a locked or bridged ribose conformation (e.g., LNA or ENA). In some cases, the polynucleic acid molecule is modified by 2'-O-methyl and/or 2'-O-methoxyethyl ribose. In some cases, the polynucleic acid molecule also includes morpholinos, PNAs, HNA, methylphosphonate nucleotides, thiolphosphonate nucleotides, and/or 2'-fluoro N3-P5'-phosphoramidites to increase its stability. In some instances, the polynucleic acid molecule is a chirally pure (or stereo pure) polynucleic acid molecule. In some instances, the chirally pure (or stereo pure) polynucleic acid molecule is modified to increase its stability. Suitable modifications to the RNA to increase stability for delivery will be apparent to the skilled person.

In some embodiments, a polynucleic acid molecule described herein has RNAi activity that modulates expression of RNA encoded by a gene described supra. In some instances, a polynucleic acid molecule described herein is a double-stranded siRNA molecule that down-regulates expression of a gene, wherein one of the strands of the double-stranded siRNA molecule comprises a nucleotide sequence that is complementary to a nucleotide sequence of the gene or RNA encoded by the gene or a portion thereof, and wherein the second strand of the double-stranded siRNA molecule comprises a nucleotide sequence substantially similar to the nucleotide sequence of the gene or RNA encoded by the gene or a portion thereof. In some cases, a polynucleic acid molecule described herein is a double-stranded siRNA molecule that down-regulates expression of a gene, wherein each strand of the siRNA molecule comprises about 15 to 25, 18 to 24, or 19 to about 23 nucleotides, and wherein each strand comprises at least about 14, 17, or 19 nucleotides that are complementary to the nucleotides of the other strand. In some cases, a polynucleic acid molecule described herein is a double-stranded siRNA molecule that down-regulates expression of a gene, wherein each strand of the siRNA molecule comprises about 19 to about 23 nucleotides, and wherein each strand comprises at least about 19 nucleotides that are complementary to the nucleotides of the other strand. In some instances, the gene is KRAS, EGFR, AR, HPRT1, CNNTB1 (β-catenin), or β-catenin associated genes.

In some embodiments, a polynucleic acid molecule described herein is constructed using chemical synthesis and/or enzymatic ligation reactions using procedures known in the art. For example, a polynucleic acid molecule is chemically synthesized using naturally occurring nucleotides or variously modified nucleotides designed to increase the biological stability of the molecules or to increase the physical stability of the duplex formed between the polynucleic acid molecule and target nucleic acids. Exemplary methods include those described in: U.S. Pat. Nos. 5,142,047; 5,185,444; 5,889,136; 6,008,400; and 6,111,086; PCT Publication No. WO2009099942; or European Publication No. 1579015. Additional exemplary methods include those described in: Griffey et al., "2'-O-aminopropyl ribonucleotides: a zwitterionic modification that enhances the exonuclease resistance and biological activity of antisense oligonucleotides," *J. Med. Chem.* 39(26):5100-5109 (1997)); Obika, et al. "Synthesis of 2'-0,4'-C-methyleneuridine and -cytidine. Novel bicyclic nucleosides having a fixed C3,-endo sugar puckering". Tetrahedron Letters 38 (50): 8735 (1997); Koizumi, M. "ENA oligonucleotides as therapeutics". *Current opinion in molecular therapeutics* 8 (2): 144-149 (2006); and Abramova et al., "Novel oligonucleotide analogues based on morpholino nucleoside subunits-antisense technologies: new chemical possibilities," Indian Journal of Chemistry 48B:1721-1726 (2009). Alternatively, the polynucleic acid molecule is produced biologically using an expression vector into which a polynucleic acid molecule has been subcloned in an antisense orientation (i.e., RNA transcribed from the inserted polynucleic acid molecule will be of an antisense orientation to a target polynucleic acid molecule of interest).

Conjugation Chemistry

In some embodiments, a polynucleic acid molecule is conjugated to a binding moiety. In some instances, the binding moiety comprises amino acids, peptides, polypeptides, proteins, antibodies, antigens, toxins, hormones, lipids, nucleotides, nucleosides, sugars, carbohydrates, polymers such as polyethylene glycol and polypropylene glycol, as well as analogs or derivatives of all of these classes of substances. Additional examples of binding moiety also include steroids, such as cholesterol, phospholipids, di- and triacylglycerols, fatty acids, hydrocarbons (e.g., saturated, unsaturated, or contains substitutions), enzyme substrates, biotin, digoxigenin, and polysaccharides. In some instances, the binding moiety is an antibody or binding fragment thereof. In some instances, the polynucleic acid molecule is further conjugated to a polymer, and optionally an endosomolytic moiety.

In some embodiments, the polynucleic acid molecule is conjugated to the binding moiety by a chemical ligation process. In some instances, the polynucleic acid molecule is conjugated to the binding moiety by a native ligation. In some instances, the conjugation is as described in: Dawson, et al. "Synthesis of proteins by native chemical ligation," Science 1994, 266, 776-779; Dawson, et al. "Modulation of Reactivity in Native Chemical Ligation through the Use of Thiol Additives," *J. Am. Chem. Soc.* 1997, 119, 4325-4329; Hackeng, et al. "Protein synthesis by native chemical ligation: Expanded scope by using straightforward methodology," *Proc. Natl. Acad. Sci. USA* 1999, 96, 10068-10073; or Wu, et al. "Building complex glycopeptides: Development of a cysteine-free native chemical ligation protocol," *Angew. Chem. Int. Ed.* 2006, 45, 4116-4125. In some instances, the conjugation is as described in U.S. Pat. No. 8,936,910. In some embodiments, the polynucleic acid molecule is conjugated to the binding moiety either site-specifically or non-specifically via native ligation chemistry.

In some instances, the polynucleic acid molecule is conjugated to the binding moiety by a site-directed method utilizing a "traceless" coupling technology (Philochem). In some instances, the "traceless" coupling technology utilizes an N-terminal 1,2-aminothiol group on the binding moiety which is then conjugate with a polynucleic acid molecule containing an aldehyde group. (see Casi et al., "Site-specific traceless coupling of potent cytotoxic drugs to recombinant antibodies for pharmacodelivery," *JACS* 134(13): 5887-5892 (2012))

In some instances, the polynucleic acid molecule is conjugated to the binding moiety by a site-directed method utilizing an unnatural amino acid incorporated into the binding moiety. In some instances, the unnatural amino acid comprises p-acetylphenylalanine (pAcPhe). In some instances, the keto group of pAcPhe is selectively coupled to an alkoxy-amine derivatived conjugating moiety to form an oxime bond. (see Axup et al., "Synthesis of site-specific antibody-drug conjugates using unnatural amino acids," *PNAS* 109(40): 16101-16106 (2012)).

In some instances, the polynucleic acid molecule is conjugated to the binding moiety by a site-directed method utilizing an enzyme-catalyzed process. In some instances, the site-directed method utilizes SMARTag™ technology (Redwood). In some instances, the SMARTag™ technology comprises generation of a formylglycine (FGly) residue from cysteine by formylglycine-generating enzyme (FGE) through an oxidation process under the presence of an aldehyde tag and the subsequent conjugation of FGly to an alkylhydraine-functionalized polynucleic acid molecule via hydrazino-Pictet-Spengler (HIPS) ligation. (see Wu et al., "Site-specific chemical modification of recombinant proteins produced in mammalian cells by using the genetically encoded aldehyde tag," *PNAS* 106(9): 3000-3005 (2009); Agarwal, et al., "A Pictet-Spengler ligation for protein chemical modification," *PNAS* 110(1): 46-51 (2013))

In some instances, the enzyme-catalyzed process comprises microbial transglutaminase (mTG). In some cases, the polynucleic acid molecule is conjugated to the binding moiety utilizing a microbial transglutaminze catalyzed process. In some instances, mTG catalyzes the formation of a covalent bond between the amide side chain of a glutamine within the recognition sequence and a primary amine of a functionalized polynucleic acid molecule. In some instances, mTG is produced from *Streptomyces mobarensis*. (see Strop et al., "Location matters: site of conjugation modulates stability and pharmacokinetics of antibody drug conjugates," *Chemistry and Biology* 20(2) 161-167 (2013))

In some instances, the polynucleic acid molecule is conjugated to the binding moiety by a method as described in PCT Publication No. WO2014/140317, which utilizes a sequence-specific transpeptidase.

In some instances, the polynucleic acid molecule is conjugated to the binding moiety by a method as described in U.S. Patent Publication Nos. 2015/0105539 and 2015/0105540.

Binding Moiety

In some embodiments, the binding moiety A is a polypeptide. In some instances, the polypeptide is an antibody or its fragment thereof. In some cases, the fragment is a binding fragment. In some instances, the antibody or binding fragment thereof comprises a humanized antibody or binding fragment thereof, murine antibody or binding fragment thereof, chimeric antibody or binding fragment thereof, monoclonal antibody or binding fragment thereof, monovalent Fab', divalent Fab$_2$, F(ab)'$_3$ fragments, single-chain variable fragment (scFv), bis-scFv, (scFv)$_2$, diabody, minibody, nanobody, triabody, tetrabody, disulfide stabilized Fv protein (dsFv), single-domain antibody (sdAb), Ig NAR, camelid antibody or binding fragment thereof, bispecific antibody or biding fragment thereof, or a chemically modified derivative thereof.

In some instances, A is an antibody or binding fragment thereof. In some instances, A is a humanized antibody or binding fragment thereof, murine antibody or binding fragment thereof, chimeric antibody or binding fragment thereof, monoclonal antibody or binding fragment thereof, monovalent Fab', divalent Fab2, F(ab)'$_3$ fragments, single-chain variable fragment (scFv), bis-scFv, (scFv)$_2$, diabody, minibody, nanobody, triabody, tetrabody, disulfide stabilized Fv protein ("dsFv"), single-domain antibody (sdAb), Ig NAR, camelid antibody or binding fragment thereof, bispecific antibody or biding fragment thereof, or a chemically modified derivative thereof. In some instances, A is a humanized antibody or binding fragment thereof. In some instances, A is a murine antibody or binding fragment thereof. In some instances, A is a chimeric antibody or binding fragment thereof. In some instances, A is a monoclonal antibody or binding fragment thereof. In some instances, A is a monovalent Fab'. In some instances, A is a diavalent Fab2. In some instances, A is a single-chain variable fragment (scFv).

In some embodiments, the binding moiety A is a bispecific antibody or binding fragment thereof. In some instances, the bispecific antibody is a trifunctional antibody or a bispecific mini-antibody. In some cases, the bispecific antibody is a trifunctional antibody. In some instances, the trifunctional antibody is a full length monoclonal antibody comprising binding sites for two different antigens. Exemplary trifunctional antibodies include catumaxomab (which targets EpCAM and CD3; Fresenius Biotech/Trion Pharma), ertumaxomab (targets HER2/neu/CD3; Fresenius Biotech/Trion Pharma), lymphomun FBTA05 (targets CD20/CD3; Fresenius Biotech/Trion Pharma), RG7221 (RO5520985; targets Angiopoietin 2/VEGF; Roche), RG7597 (targets Her1/Her3; Genentech/Roche), MM141 (targets IGF1R/Her3; Merrimack), ABT122 (targets TNFα/IL17; Abbvie), ABT981 (targets IL1α/IL1β; Abbott), LY3164530 (targets Her1/cMET; Eli Lilly), and TRBS07 (Ektomab; targets GD2/CD3; Trion Research Gmbh). Additional exemplary trifunctional antibodies include mAb$^2$ from F-star Biotechnology Ltd. In some instances, A is a bispecific trifunctional antibody. In some embodiments, A is a bispecific trifunctional antibody selected from: catumaxomab (which targets EpCAM and CD3; Fresenius Biotech/Trion Pharma), ertumaxomab (targets HER2/neu/CD3; Fresenius Biotech/Trion Pharma), lymphomun FBTA05 (targets CD20/CD3; Fresenius Biotech/Trion Pharma), RG7221 (R05520985; targets Angiopoietin 2/VEGF; Roche), RG7597 (targets Her1/Her3; Genentech/Roche), MM141 (targets IGF1R/Her3; Merrimack), ABT122 (targets TNFα/IL17; Abbvie), ABT981 (targets IL1α/IL1β; Abbott), LY3164530 (targets Her1/cMET; Eli Lilly), TRBS07 (Ektomab; targets GD2/CD3; Trion Research Gmbh), and a mAb$^2$ from F-star Biotechnology Ltd.

In some cases, the bispecific antibody is a bispecific mini-antibody. In some instances, the bispecific mini-antibody comprises divalent Fab2, F(ab)'3 fragments, bis-scFv, (scFv)$_2$, diabody, minibody, triabody, tetrabody or a bi-specific T-cell engager (BiTE). In some embodiments, the bi-specific T-cell engager is a fusion protein that contains two single-chain variable fragments (scFvs) in which the two scFvs target epitopes of two different antigens. Exemplary bispecific mini-antibodies include, but are not limited to, DAR1 (dual-affinity re-targeting platform; MacroGenics), blinatumomab (MT103 or AMG103; which targets CD19/CD3; Micromet), MT111 (targets CEA/CD3; Micromet/Amegen), MT112 (BAY2010112; targets PSMA/CD3; Micromet/Bayer), MT110 (AMG 110; targets EPCAM/CD3; Amgen/Micromet), MGD006 (targets CD123/CD3; MacroGenics), MGD007 (targets GPA33/CD3; MacroGenics), BI1034020 (targets two different epitopes on β-amyloid; Ablynx), ALX0761 (targets IL17A/IL17F; Ablynx), TF2 (targets CEA/hepten; Immunomedics), IL-17/IL-34 biAb (BMS), AFM13 (targets CD30/CD16; Affimed), AFM11 (targets CD19/CD3; Affimed), and domain antibodies (dAbs from Domantis/GSK).

In some embodiments, the binding moiety A is a bispecific mini-antibody. In some instances, A is a bispecific Fab$_2$. In some instances, A is a bispecific F(ab)'$_3$ fragment. In some cases, A is a bispecific bis-scFv. In some cases, A is a bispecific (scFv)$_2$. In some embodiments, A is a bispecific diabody. In some embodiments, A is a bispecific minibody. In some embodiments, A is a bispecific triabody. In other embodiments, A is a bispecific tetrabody. In other embodiments, A is a bi-specific T-cell engager (BiTE). In additional embodiments, A is a bispecific mini-antibody selected from: DAR1 (dual-affinity re-targeting platform; MacroGenics), blinatumomab (MT103 or AMG103; which targets CD19/CD3; Micromet), MT111 (targets CEA/CD3; Micromet/Amegen), MT112 (BAY2010112; targets PSMA/CD3; Micromet/Bayer), MT110 (AMG110; targets EPCAM/CD3; Amgen/Micromet), MGD006 (targets CD123/CD3; MacroGenics), MGD007 (targets GPA33/CD3; MacroGenics), BI1034020 (targets two different epitopes on β-amyloid; Ablynx), ALX0761 (targets IL17A/IL17F; Ablynx), TF2 (targets CEA/hepten; Immunomedics), IL-17/IL-34 biAb (BMS), AFM13 (targets CD30/CD16; Affimed), AFM11 (targets CD19/CD3; Affimed), and domain antibodies (dAbs from Domantis/GSK).

In some embodiments, the binding moiety A is a trispecific antibody. In some instances, the trispecific antibody comprises F(ab)'3 fragments or a triabody. In some instances, A is a trispecific F(ab)'$_3$ fragment. In some cases, A is a triabody. In some embodiments, A is a trispecific antibody as described in Dimas, et al., "Development of a trispecific antibody designed to simultaneously and efficiently target three different antigens on tumor cells," *Mol. Pharmaceutics,* 12(9): 3490-3501 (2015).

In some embodiments, the binding moiety A is an antibody or binding fragment thereof that recognizes a cell surface protein. In some instances, the cell surface protein is an antigen expressed by a cancerous cell. Exemplary cancer antigens include, but are not limited to, alpha fetoprotein, ASLG659, B7-H3, BAFF-R, Brevican, CA125 (MUC16), CA15-3, CA19-9, carcinoembryonic antigen (CEA), CA242, CRIPTO (CR, CR1, CRGF, CRIPTO, TDGF1, teratocarcinoma-derived growth factor), CTLA-4, CXCR5, E16 (LAT1, SLC7A5), FcRH2 (IFGP4, IRTA4, SPAP1A (SH2 domain containing phosphatase anchor protein 1a), SPAP1B, SPAP1C), epidermal growth factor, ETBR, Fc receptor-like protein 1 (FCRH1), GEDA, HLA-DOB (Beta subunit of MHC class II molecule (Ia antigen), human chorionic gonadotropin, ICOS, IL-2 receptor, IL20Rα, Immunoglobulin superfamily receptor translocation associated 2 (IRTA2), L6, Lewis Y, Lewis X, MAGE-1, MAGE-2, MAGE-3, MAGE 4, MARTI, mesothelin, MDP, MPF (SMR, MSLN), MCP1 (CCL2), macrophage inhibitory factor (MIF), MPG, MSG783, mucin, MUC1-KLH, Napi3b (SLC34A2), nectin-4, Neu oncogene product, NCA, placental alkaline phosphatase, prostate specific membrane antigen (PMSA), prostatic acid phosphatase, PSCA hlg, p97, Purinergic receptor P2X ligand-gated ion channel 5 (P2X5), LY64 (Lymphocyte antigen 64 (RP105), gp100, P21, six transmembrane epithelial antigen of prostate (STEAP1), STEAP2, Sema 5b, tumor-associated glycoprotein 72 (TAG-72), TrpM4 (BR22450, FLJ20041, TRPM4, TRPM4B, transient receptor potential cation channel, subfamily M, member 4) and the like.

In some instances, the cell surface protein comprises clusters of differentiation (CD) cell surface markers. Exemplary CD cell surface markers include, but are not limited to, CD1, CD2, CD3, CD4, CD5, CD6, CD7, CD8, CD9, CD10, CD11a, CD11b, CD11c, CD11d, CDw12, CD13, CD14, CD15, CD15s, CD16, CDw17, CD18, CD19, CD20, CD21, CD22, CD23, CD24, CD25, CD26, CD27, CD28, CD29, CD30, CD31, CD32, CD33, CD34, CD35, CD36, CD37, CD38, CD39, CD40, CD41, CD42, CD43, CD44, CD45, CD45RO, CD45RA, CD45RB, CD46, CD47, CD48, CD49a, CD49b, CD49c, CD49d, CD49e, CD49f, CD50, CD51, CD52, CD53, CD54, CD55, CD56, CD57, CD58, CD59, CDw60, CD61, CD62E, CD62L (L-selectin), CD62P, CD63, CD64, CD65, CD66a, CD66b, CD66c, CD66d, CD66e, CD79 (e.g., CD79a, CD79b), CD90, CD95 (Fas), CD103, CD104, CD125 (IL5RA), CD134 (OX40), CD137 (4-1BB), CD152 (CTLA-4), CD221, CD274, CD279 (PD-1), CD319 (SLAMF7), CD326 (EpCAM), and the like.

In some instances, the binding moiety A is an antibody or binding fragment thereof that recognizes a cancer antigen. In some instances, the binding moiety A is an antibody or binding fragment thereof that recognizes a transferrin receptor, alpha fetoprotein, ASLG659, B7-H3, BAFF-R, Brevican, CA125 (MUC16), CA15-3, CA19-9, carcinoembryonic antigen (CEA), CA242, CRIPTO (CR, CR1, CRGF, CRIPTO, TDGF1, teratocarcinoma-derived growth factor), CTLA-4, CXCR5, E16 (LAT1, SLC7A5), FcRH2 (IFGP4, IRTA4, SPAP1A (SH2 domain containing phosphatase anchor protein 1a), SPAP1B, SPAP1C), epidermal growth factor, ETBR, Fc receptor-like protein 1 (FCRH1), GEDA, HLA-DOB (Beta subunit of MHC class II molecule (Ia antigen), human chorionic gonadotropin, ICOS, IL-2 receptor, IL20Ra, Immunoglobulin superfamily receptor translocation associated 2 (IRTA2), L6, Lewis Y, Lewis X, MAGE-1, MAGE-2, MAGE-3, MAGE 4, MART1, mesothelin, MCP1 (CCL2), MDP, macrophage inhibitory factor (MIF), MPF (SMR, MSLN), MPG, MSG783, mucin, MUC1-KLH, Napi3b (SLC34A2), nectin-4, Neu oncogene product, NCA, placental alkaline phosphatase, prostate specific membrane antigen (PMSA), prostatic acid phosphatase, PSCA hlg, p9'7, Purinergic receptor P2X ligand-gated ion channel 5 (P2X5), LY64 (Lymphocyte antigen 64 (RP105), gp100, P21, six transmembrane epithelial antigen of prostate (STEAP1), STEAP2, Sema 5b, tumor-associated glycoprotein 72 (TAG-72), TrpM4 (BR22450, FLJ20041, TRPM4, TRPM4B, transient receptor potential cation channel, subfamily M, member 4) or a combination thereof.

In some instances, the binding moiety A is an antibody or binding fragment thereof that recognizes a CD cell surface marker. In some instances, the binding moiety A is an antibody or binding fragment thereof that recognizes CD1, CD2, CD3, CD4, CD5, CD6, CD7, CD8, CD9, CD10, CD11a, CD11b, CD11c, CD11d, CDw12, CD13, CD14, CD15, CD15s, CD16, CDw17, CD18, CD19, CD20, CD21, CD22, CD23, CD24, CD25, CD26, CD27, CD28, CD29, CD30, CD31, CD32, CD33, CD34, CD35, CD36, CD37, CD38, CD39, CD40, CD41, CD42, CD43, CD44, CD45, CD45RO, CD45RA, CD45RB, CD46, CD47, CD48, CD49a, CD49b, CD49c, CD49d, CD49e, CD49f, CD50, CD51, CD52, CD53, CD54, CD55, CD56, CD57, CD58, CD59, CDw60, CD61, CD62E, CD62L (L-selectin), CD62P, CD63, CD64, CD65, CD66a, CD66b, CD66c, CD66d, CD66e, CD79 (e.g., CD79a, CD79b), CD90, CD95 (Fas), CD103, CD104, CD125 (IL5RA), CD134 (OX40), CD137 (4-1BB), CD152 (CTLA-4), CD221, CD274, CD279 (PD-1), CD319 (SLAMF7), CD326 (EpCAM), or a combination thereof.

In some embodiments, the antibody or binding fragment thereof comprises zalutumumab (HuMax-EFGr, Genmab), abagovomab (Menarini), abituzumab (Merck), adecatumumab (MT201), alacizumab pegol, alemtuzumab (Campath®, MabCampath, or Campath-1H; Leukosite), Allo-Mune (BioTransplant), amatuximab (Morphotek, Inc.), anti-VEGF (Genetech), anatumomab mafenatox, apolizumab (hu1D10), ascrinvacumab (Pfizer Inc.), atezolizumab (MPDL3280A; Genentech/Roche), B43.13 (OvaRex, AltaRex Corporation), basiliximab (Simulect®, Novartis), belimumab (Benlysta®, GlaxoSmithKline), bevacizumab (Avastin®, Genentech), blinatumomab (Blincyto, AMG103; Amgen), BEC2 (ImGlone Systems Inc.), carlumab (Janssen Biotech), catumaxomab (Removab, Trion Pharma), CEAcide (Immunomedics), Cetuximab (Erbitux®, ImClone), citatuzumab bogatox (VB6-845), cixutumumab (IMC-A12, ImClone Systems Inc.), conatumumab (AMG 655, Amgen), dacetuzumab (SGN-40, huS2C6; Seattle Genetics, Inc.), daratumumab (Darzalex®, Janssen Biotech), detumomab, drozitumab (Genentech), durvalumab (MedImmune), dusigitumab (MedImmune), edrecolomab (MAb17-1A, Panorex, Glaxo Wellcome), elotuzumab (Empliciti™, Bristol-Myers Squibb), emibetuzumab (Eli Lilly), enavatuzumab (Facet Biotech Corp.), enfortumab vedotin (Seattle Genetics, Inc.), enoblituzumab (MGA271, MacroGenics, Inc.), ensituxumab (Neogenix Oncology, Inc.), epratuzumab (LymphoCide, Immunomedics, Inc.), ertumaxomab (Rexomun®, Trion Pharma), etaracizumab (Abegrin, MedImmune), farletuzumab (MORAb-003, Morphotek, Inc), FBTA05 (Lymphomun, Trion Pharma), ficlatuzumab (AVEO Pharmaceuticals), figitumumab (CP-751871, Pfizer), flanvotumab (ImClone Systems), fresolimumab (GC1008, Aanofi-Aventis), futuximab, glaximab, ganitumab (Amgen), girentuximab (Rencarex®, Wilex AG), IMAB362 (Claudiximab, Ganymed Pharmaceuticals AG), imalumab (Baxalta), IMC-1C11 (ImClone Systems), IMC-C225 (ImClone Systems Inc.), imgatuzumab (Genentech/Roche), intetumumab (Centocor, Inc.), ipilimumab (Yervoy®, Bristol-Myers Squibb), iratumumab (Medarex, Inc.), isatuximab (SAR650984, Sanofi-Aventis), labetuzumab (CEA-CIDE, Immunomedics), lexatumumab (ETR2-ST01, Cambridge Antibody Technology), lintuzumab (SGN-33, Seattle Genetics), lucatumumab (Novartis), lumiliximab, mapatumumab (HGS-ETR1, Human Genome Sciences), matuzumab (EMD 72000, Merck), milatuzumab (hLL1, Immunomedics, Inc.), mitumomab (BEC-2, ImClone Systems), narnatumab (ImClone Systems), necitumumab (Portrazza™, Eli Lilly), nesvacumab (Regeneron Pharmaceuticals), nimotuzumab (h-R3, BIOMAb EGFR, TheraCIM, Theraloc, or CIMAher; Biotech Pharmaceutical Co.), nivolumab (Opdivo®, Bristol-Myers Squibb), obinutuzumab (Gazyva or Gazyvaro; Hoffmann-La Roche), ocaratuzumab (AME-133v, LY2469298; Mentrik Biotech, LLC), ofatumumab (Arzerra®, Genmab), onartuzumab (Genentech), Ontuxizumab (Morphotek, Inc.), oregovomab (OvaRex®, AltaRex Corp.), otlertuzumab (Emergent BioSolutions), panitumumab (ABX-EGF, Amgen), pankomab (Glycotope GMBH), parsatuzumab (Genentech), patritumab, pembrolizumab (Keytruda®, Merck), pemtumomab (Theragyn, Antisoma), pertuzumab (Perjeta, Genentech), pidilizumab (CT-011, Medivation), polatuzumab vedotin (Genentech/Roche), pritumumab, racotumomab (Vaxira®, Recombio), ramucirumab (Cyramza®, ImClone Systems Inc.), rituximab (Rituxan®, Genentech), robatumumab (Schering-Plough), Seribantumab (Sanofi/Merrimack Pharmaceuticals, Inc.), sibrotuzumab, siltuximab (Sylvant™, Janssen Biotech), Smart M195 (Protein Design Labs, Inc.), Smart ID10 (Protein Design Labs, Inc.), tabalumab (LY2127399, Eli Lilly), taplitumomab paptox, tenatumomab, teprotumumab (Roche), tetulomab, TGN1412 (CD28-SuperMAB or TAB08), tigatuzumab (CD-1008, Daiichi Sankyo), tositumomab, trastuzumab (Herceptin®), tremelimumab (CP-672,206; Pfizer), tucotuzumab celmoleukin (EMD Pharmaceuticals), ublituximab, urelumab (BMS-663513, Bristol-Myers Squibb), volociximab (M200, Biogen Idec), zatuximab, and the like.

In some embodiments, the binding moiety A comprises zalutumumab (HuMax-EFGr, Genmab), abagovomab (Menarini), abituzumab (Merck), adecatumumab (MT201), alacizumab pegol, alemtuzumab (Campath®, MabCampath, or Campath-1H; Leukosite), AlloMune (BioTransplant), amatuximab (Morphotek, Inc.), anti-VEGF (Genetech), anatumomab mafenatox, apolizumab (hu1D10), ascrinvacumab (Pfizer Inc.), atezolizumab (MPDL3280A; Genentech/Roche), B43.13 (OvaRex, AltaRex Corporation), basiliximab (Simulect®, Novartis), belimumab (Benlysta®, GlaxoSmithKline), bevacizumab (Avastin®, Genentech), blinatumomab (Blincyto, AMG103; Amgen), BEC2 (ImGlone Systems Inc.), carlumab (Janssen Biotech), catumaxomab (Removab, Trion Pharma), CEAcide (Immunomedics), Cetuximab (Erbitux®, ImClone), citatuzumab bogatox (VB6-845), cixutumumab (IMC-A12, ImClone Systems Inc.), conatumumab (AMG 655, Amgen), dacetuzumab (SGN-40, huS2C6; Seattle Genetics, Inc.), daratumumab (Darzalex®, Janssen Biotech), detumomab, drozitumab (Genentech), durvalumab (MedImmune), dusigitumab (MedImmune), edrecolomab (MAb17-1A, Panorex, Glaxo Wellcome), elotuzumab (Empliciti™, Bristol-Myers Squibb), emibetuzumab (Eli Lilly), enavatuzumab (Facet Biotech Corp.), enfortumab vedotin (Seattle Genetics, Inc.), enoblituzumab (MGA271, MacroGenics, Inc.), ensituxumab (Neogenix Oncology, Inc.), epratuzumab (LymphoCide, Immunomedics, Inc.), ertumaxomab (Rexomun®, Trion Pharma), etaracizumab (Abegrin, MedImmune), farletuzumab (MORAb-003, Morphotek, Inc), FBTA05 (Lymphomun, Trion Pharma), ficlatuzumab (AVEO Pharmaceuticals), figitumumab (CP-751871, Pfizer), flanvotumab (ImClone Systems), fresolimumab (GC1008, Aanofi-Aventis), futuximab, glaximab, ganitumab (Amgen), girentuximab (Rencarex®, Wilex AG), IMAB362 (Claudiximab, Ganymed Pharmaceuticals AG), imalumab (Baxalta), IMC-1C11 (ImClone Systems), IMC-C225 (Imclone Systems Inc.), imgatuzumab (Genentech/Roche), intetumumab (Centocor, Inc.), ipilimumab (Yervoy®, Bristol-Myers Squibb), iratumumab (Medarex, Inc.), isatuximab (SAR650984, Sanofi-Aventis), labetuzumab (CEA-CIDE, Immunomedics), lexatumumab (ETR2-ST01, Cambridge Antibody Technology), lintuzumab (SGN-33, Seattle Genetics), lucatumumab (Novartis), lumiliximab, mapatumumab (HGS-ETR1, Human Genome Sciences), matuzumab (EMD 72000, Merck), milatuzumab (hLL1, Immunomedics, Inc.), mitumomab (BEC-2, ImClone Systems), narnatumab (ImClone Systems), necitumumab (Portrazza™, Eli Lilly), nesvacumab (Regeneron Pharmaceuticals), nimotuzumab (h-R3, BIOMAb EGFR, TheraCIM, Theraloc, or CIMAher; Biotech Pharmaceutical Co.), nivolumab (Opdivo®, Bristol-Myers Squibb), obinutuzumab (Gazyva or Gazyvaro; Hoffmann-La Roche), ocaratuzumab (AME-133v, LY2469298; Mentrik Biotech, LLC), ofatumumab (Arzerra®, Genmab), onartuzumab (Genentech), Ontuxizumab (Morphotek, Inc.), oregovomab (OvaRex®, AltaRex Corp.), otlertuzumab (Emergent BioSolutions), panitumumab (ABX-EGF, Amgen), pankomab (Glycotope GMBH), parsatuzumab (Genentech), patritumab, pembrolizumab (Keytruda®, Merck), pemtumomab (Theragyn, Antisoma), pertuzumab (Perjeta, Genentech), pidilizumab (CT-011, Medivation), polatuzumab vedotin (Genentech/Roche), pritumumab, racotumomab (Vaxira®, Recombio), ramucirumab (Cyramza®, ImClone Systems Inc.), rituximab (Rituxan®, Genentech), robatumumab (Schering-Plough), Seribantumab (Sanofi/Merrimack Pharmaceuticals, Inc.), sibrotuzumab, siltuximab (Sylvant™, Janssen Biotech), Smart MI95 (Protein Design Labs, Inc.), Smart ID10 (Protein Design Labs, Inc.), tabalumab (LY2127399, Eli Lilly), taplitumomab paptox, tenatumomab, teprotumumab (Roche), tetulomab, TGN1412 (CD28-SuperMAB or TAB08), tigatuzumab (CD-1008, Daiichi Sankyo), tositumomab, trastuzumab (Herceptin®), tremelimumab (CP-672,206; Pfizer), tucotuzumab celmoleukin (EMD Pharmaceuticals), ublituximab, urelumab (BMS-663513, Bristol-Myers Squibb), volociximab (M200, Biogen Idec), or zatuximab. In some embodiments, the binding moiety A is zalutumumab (HuMax-EFGr, by Genmab).

In some embodiments, the binding moiety A is conjugated according to Formula (I) to a polynucleic acid molecule (B), and a polymer (C), and optionally an endosomolytic moiety (D) according to Formula (II) described herein. In some instances, the polynucleic acid molecule comprises a sequence having at least 50%, 55%, 60%, 65%, 70%, 75%, 80%, 85%, 90%, 95%, 96%, 97%, 98%, 99%, or 100% sequence identity to a sequence listed in Tables 2, 3, 5, 6, 7, 9, or 11. In some embodiments, the polynucleic acid molecule comprises a sequence having at least 50%, 55%, 60%, 65%, 70%, 75%, 80%, 85%, 90%, 95%, 96%, 97%, 98%, 99%, or 100% sequence identity to SEQ ID NOs: 16-75, 452-1955, 1956-1962, 1967-2002, 2013-2032, 2082-2109, or 2117. In some instances, the polynucleic acid molecule comprises a sequence selected from SEQ ID NOs: 16-75, 452-1955, 1956-1962, 1967-2002, 2013-2032, 2082-2109, or 2117. In some instances, the polymer C comprises polyalkylen oxide (e.g., polyethylene glycol). In some embodiments, the endosomolytic moiety D comprises INF7 or melittin, or their respective derivatives.

In some embodiments, the binding moiety A is conjugated to a polynucleic acid molecule (B), and a polymer (C), and optionally an endosomolytic moiety (D) as illustrated in FIG. 1. In some instances, the binding moiety A is an antibody or binding fragment thereof.

In some embodiments, the binding moiety A is conjugated to a polynucleic acid molecule (B) non-specifically. In some instances, the binding moiety A is conjugated to a polynucleic acid molecule (B) via a lysine residue or a cysteine residue, in a non-site specific manner. In some instances, the binding moiety A is conjugated to a polynucleic acid molecule (B) via a lysine residue in a non-site specific manner. In some cases, the binding moiety A is conjugated to a polynucleic acid molecule (B) via a cysteine residue in a non-site specific manner. In some instances, the binding moiety A is an antibody or binding fragment thereof.

In some embodiments, the binding moiety A is conjugated to a polynucleic acid molecule (B) in a site-specific manner.

In some instances, the binding moiety A is conjugated to a polynucleic acid molecule (B) through a lysine residue, a cysteine residue, at the 5'-terminus, at the 3'-terminus, an unnatural amino acid, or an enzyme-modified or enzyme-catalyzed residue, via a site-specific manner. In some instances, the binding moiety A is conjugated to a polynucleic acid molecule (B) through a lysine residue via a site-specific manner. In some instances, the binding moiety A is conjugated to a polynucleic acid molecule (B) through a cysteine residue via a site-specific manner. In some instances, the binding moiety A is conjugated to a polynucleic acid molecule (B) at the 5'-terminus via a site-specific manner. In some instances, the binding moiety A is conjugated to a polynucleic acid molecule (B) at the 3'-terminus via a site-specific manner. In some instances, the binding moiety A is conjugated to a polynucleic acid molecule (B) through an unnatural amino acid via a site-specific manner. In some instances, the binding moiety A is conjugated to a polynucleic acid molecule (B) through an enzyme-modified or enzyme-catalyzed residue via a site-specific manner. In some instances, the binding moiety A is an antibody or binding fragment thereof.

In some embodiments, one or more regions of a binding moiety A (e.g., an antibody or binding fragment thereof) is conjugated to a polynucleic acid molecule (B). In some instances, the one or more regions of a binding moiety A comprise the N-terminus, the C-terminus, in the constant region, at the hinge region, or the Fc region of the binding moiety A. In some instances, the polynucleic acid molecule (B) is conjugated to the N-terminus of the binding moiety A (e.g., the N-terminus of an antibody or binding fragment thereof). In some instances, the polynucleic acid molecule (B) is conjugated to the C-terminus of the binding moiety A (e.g., the N-terminus of an antibody or binding fragment thereof). In some instances, the polynucleic acid molecule (B) is conjugated to the constant region of the binding moiety A (e.g., the constant region of an antibody or binding fragment thereof). In some instances, the polynucleic acid molecule (B) is conjugated to the hinge region of the binding moiety A (e.g., the constant region of an antibody or binding fragment thereof). In some instances, the polynucleic acid molecule (B) is conjugated to the Fc region of the binding moiety A (e.g., the constant region of an antibody or binding fragment thereof).

In some embodiments, one or more polynucleic acid molecule (B) is conjugated to a binding moiety A. In some instances, about 1, 2, 3, 4, 5, 6, 7, 8, 9, 10, 11, 12, 13, 14, 15, 16, or more polynucleic acid molecules are conjugated to one binding moiety A. In some instances, about 1 polynucleic acid molecule is conjugated to one binding moiety A. In some instances, about 2 polynucleic acid molecules are conjugated to one binding moiety A. In some instances, about 3 polynucleic acid molecules are conjugated to one binding moiety A. In some instances, about 4 polynucleic acid molecules are conjugated to one binding moiety A. In some instances, about 5 polynucleic acid molecules are conjugated to one binding moiety A. In some instances, about 6 polynucleic acid molecules are conjugated to one binding moiety A. In some instances, about 7 polynucleic acid molecules are conjugated to one binding moiety A. In some instances, about 8 polynucleic acid molecules are conjugated to one binding moiety A. In some instances, about 9 polynucleic acid molecules are conjugated to one binding moiety A. In some instances, about 10 polynucleic acid molecules are conjugated to one binding moiety A. In some instances, about 11 polynucleic acid molecules are conjugated to one binding moiety A. In some instances, about 12 polynucleic acid molecules are conjugated to one binding moiety A. In some instances, about 13 polynucleic acid molecules are conjugated to one binding moiety A. In some instances, about 14 polynucleic acid molecules are conjugated to one binding moiety A. In some instances, about 15 polynucleic acid molecules are conjugated to one binding moiety A. In some instances, about 16 polynucleic acid molecules are conjugated to one binding moiety A. In some cases, the one or more polynucleic acid molecules are the same. In other cases, the one or more polynucleic acid molecules are different. In some instances, the binding moiety A is an antibody or binding fragment thereof.

In some embodiments, the number of polynucleic acid molecule (B) conjugated to a binding moiety A (e.g., an antibody or binding fragment thereof) forms a ratio. In some instances, the ratio is referred to as a DAR (drug-to-antibody) ratio, in which the drug as referred to herein is the polynucleic acid molecule (B). In some instances, the DAR ratio of the polynucleic acid molecule (B) to binding moiety A is about 1, 2, 3, 4, 5, 6, 7, 8, 9, 10, 11, 12, 13, 14, 15, 16, or greater. In some instances, the DAR ratio of the polynucleic acid molecule (B) to binding moiety A is about 1 or greater. In some instances, the DAR ratio of the polynucleic acid molecule (B) to binding moiety A is about 2 or greater. In some instances, the DAR ratio of the polynucleic acid molecule (B) to binding moiety A is about 3 or greater. In some instances, the DAR ratio of the polynucleic acid molecule (B) to binding moiety A is about 4 or greater. In some instances, the DAR ratio of the polynucleic acid molecule (B) to binding moiety A is about 5 or greater. In some instances, the DAR ratio of the polynucleic acid molecule (B) to binding moiety A is about 6 or greater. In some instances, the DAR ratio of the polynucleic acid molecule (B) to binding moiety A is about 7 or greater. In some instances, the DAR ratio of the polynucleic acid molecule (B) to binding moiety A is about 8 or greater. In some instances, the DAR ratio of the polynucleic acid molecule (B) to binding moiety A is about 9 or greater. In some instances, the DAR ratio of the polynucleic acid molecule (B) to binding moiety A is about 10 or greater. In some instances, the DAR ratio of the polynucleic acid molecule (B) to binding moiety A is about 11 or greater. In some instances, the DAR ratio of the polynucleic acid molecule (B) to binding moiety A is about 12 or greater.

In some instances, the DAR ratio of the polynucleic acid molecule (B) to binding moiety A (e.g., an antibody or binding fragment thereof) is about 1, 2, 3, 4, 5, 6, 7, 8, 9, 10, 11, 12, 13, 14, 15, or 16. In some instances, the DAR ratio of the polynucleic acid molecule (B) to binding moiety A is about 1. In some instances, the DAR ratio of the polynucleic acid molecule (B) to binding moiety A is about 2. In some instances, the DAR ratio of the polynucleic acid molecule (B) to binding moiety A is about 3. In some instances, the DAR ratio of the polynucleic acid molecule (B) to binding moiety A is about 4. In some instances, the DAR ratio of the polynucleic acid molecule (B) to binding moiety A is about 5. In some instances, the DAR ratio of the polynucleic acid molecule (B) to binding moiety A is about 6. In some instances, the DAR ratio of the polynucleic acid molecule (B) to binding moiety A is about 7. In some instances, the DAR ratio of the polynucleic acid molecule (B) to binding moiety A is about 8. In some instances, the DAR ratio of the polynucleic acid molecule (B) to binding moiety A is about 9. In some instances, the DAR ratio of the polynucleic acid molecule (B) to binding moiety A is about 10. In some instances, the DAR ratio of the polynucleic acid molecule (B) to binding moiety A is about 11. In some instances, the DAR ratio of the polynucleic acid molecule (B) to binding moiety A is about 12. In some instances, the DAR ratio of the polynucleic acid molecule (B) to binding moiety A is about 13. In some instances, the DAR ratio of the polynucleic acid molecule (B) to binding moiety A is about 14. In some instances, the DAR ratio of the polynucleic acid molecule (B) to binding moiety A is about 15. In some instances, the DAR ratio of the polynucleic acid molecule (B) to binding moiety A is about 16.

In some instances, the DAR ratio of the polynucleic acid molecule (B) to binding moiety A is 1, 2, 3, 4, 5, 6, 7, 8, 9, 10, 11, 12, 13, 14, 15, or 16. In some instances, the DAR ratio of the polynucleic acid molecule (B) to binding moiety A is 1. In some instances, the DAR ratio of the polynucleic acid molecule (B) to binding moiety A is 2. In some instances, the DAR ratio of the polynucleic acid molecule (B) to binding moiety A is 4. In some instances, the DAR ratio of the polynucleic acid molecule (B) to binding moiety A is 6. In some instances, the DAR ratio of the polynucleic acid molecule (B) to binding moiety A is 8. In some instances, the DAR ratio of the polynucleic acid molecule (B) to binding moiety A is 12.

In some embodiments, an antibody or its binding fragment is further modified using conventional techniques known in the art, for example, by using amino acid deletion, insertion, substitution, addition, and/or by recombination and/or any other modification (e.g. posttranslational and chemical modifications, such as glycosylation and phosphorylation) known in the art either alone or in combination. In some instances, the modification further comprises a modification for modulating interaction with Fc receptors. In some instances, the one or more modifications include those described in, for example, International Publication No. WO97/34631, which discloses amino acid residues involved in the interaction between the Fc domain and the FcRn receptor. Methods for introducing such modifications in the nucleic acid sequence underlying the amino acid sequence of an antibody or its binding fragment is well known to the person skilled in the art.

In some instances, an antibody binding fragment further encompasses its derivatives and includes polypeptide sequences containing at least one CDR.

In some instances, the term "single-chain" as used herein means that the first and second domains of a bi-specific single chain construct are covalently linked, preferably in the form of a co-linear amino acid sequence encodable by a single nucleic acid molecule.

In some instances, a bispecific single chain antibody construct relates to a construct comprising two antibody derived binding domains. In such embodiments, bi-specific single chain antibody construct is tandem bi-scFv or diabody. In some instances, a scFv contains a VH and VL domain connected by a linker peptide. In some instances, linkers are of a length and sequence sufficient to ensure that each of the first and second domains can, independently from one another, retain their differential binding specificities.

In some embodiments, binding to or interacting with as used herein defines a binding/interaction of at least two antigen-interaction-sites with each other. In some instances, antigen-interaction-site defines a motif of a polypeptide that shows the capacity of specific interaction with a specific antigen or a specific group of antigens. In some cases, the binding/interaction is also understood to define a specific recognition. In such cases, specific recognition refers to that the antibody or its binding fragment is capable of specifically interacting with and/or binding to at least two amino acids of each of a target molecule. For example, specific recognition relates to the specificity of the antibody molecule, or to its ability to discriminate between the specific regions of a target molecule. In additional instances, the specific interaction of the antigen-interaction-site with its specific antigen results in an initiation of a signal, e.g. due to the induction of a change of the conformation of the antigen, an oligomerization of the antigen, etc. In further embodiments, the binding is exemplified by the specificity of a "key-lock-principle". Thus in some instances, specific motifs in the amino acid sequence of the antigen-interaction-site and the antigen bind to each other as a result of their primary, secondary or tertiary structure as well as the result of secondary modifications of said structure. In such cases, the specific interaction of the antigen-interaction-site with its specific antigen results as well in a simple binding of the site to the antigen.

In some instances, specific interaction further refers to a reduced cross-reactivity of the antibody or its binding fragment or a reduced off-target effect. For example, the antibody or its binding fragment that bind to the polypeptide/protein of interest but do not or do not essentially bind to any of the other polypeptides are considered as specific for the polypeptide/protein of interest. Examples for the specific interaction of an antigen-interaction-site with a specific antigen comprise the specificity of a ligand for its receptor, for example, the interaction of an antigenic determinant (epitope) with the antigenic binding site of an antibody.

Additional Binding Moieties

In some embodiments, the binding moiety is a plasma protein. In some instances, the plasma protein comprises albumin. In some instances, the binding moiety A is albumin. In some instances, albumin is conjugated by one or more of a conjugation chemistry described herein to a polynucleic acid molecule. In some instances, albumin is conjugated by native ligation chemistry to a polynucleic acid molecule. In some instances, albumin is conjugated by lysine conjugation to a polynucleic acid molecule.

In some instances, the binding moiety is a steroid. Exemplary steroids include cholesterol, phospholipids, di- and triacylglycerols, fatty acids, hydrocarbons that are saturated, unsaturated, comprise substitutions, or combinations thereof. In some instances, the steroid is cholesterol. In some instances, the binding moiety is cholesterol. In some instances, cholesterol is conjugated by one or more of a conjugation chemistry described herein to a polynucleic acid molecule. In some instances, cholesterol is conjugated by native ligation chemistry to a polynucleic acid molecule. In some instances, cholesterol is conjugated by lysine conjugation to a polynucleic acid molecule.

In some instances, the binding moiety is a polymer, including but not limited to poly nucleic acid molecule aptamers that bind to specific surface markers on cells. In this instance the binding moiety is a polynucleic acid that does not hybridize to a target gene or mRNA, but instead is capable of selectively binding to a cell surface marker similarly to an antibody binding to its specific epitope of a cell surface marker.

In some cases, the binding moiety is a peptide. In some cases, the peptide comprises between about 1 and about 3 kDa. In some cases, the peptide comprises between about 1.2 and about 2.8 kDa, about 1.5 and about 2.5 kDa, or about 1.5 and about 2 kDa. In some instances, the peptide is a bicyclic peptide. In some cases, the bicyclic peptide is a constrained bicyclic peptide. In some instances, the binding moiety is a bicyclic peptide (e.g., bicycles from Bicycle Therapeutics).

In additional cases, the binding moiety is a small molecule. In some instances, the small molecule is an antibody-recruiting small molecule. In some cases, the antibody-recruiting small molecule comprises a target-binding terminus and an antibody-binding terminus, in which the target-binding terminus is capable of recognizing and interacting with a cell surface receptor. For example, in some instances, the target-binding terminus comprising a glutamate urea compound enables interaction with PSMA, thereby, enhances an antibody interaction with a cell (e.g., a cancerous cell) that expresses PSMA. In some instances, a binding moiety is a small molecule described in Zhang et al., "A remote arene-binding site on prostate specific membrane antigen revealed by antibody-recruiting small molecules," J Am Chem Soc. 132(36): 12711-12716 (2010); or McEnaney, et al., "Antibody-recruiting molecules: an emerging paradigm for engaging immune function in treating human disease," ACS Chem Biol. 7(7): 1139-1151 (2012).

Production of Antibodies or Binding Fragments Thereof

In some embodiments, polypeptides described herein (e.g., antibodies and its binding fragments) are produced using any method known in the art to be useful for the synthesis of polypeptides (e.g., antibodies), in particular, by chemical synthesis or by recombinant expression, and are preferably produced by recombinant expression techniques.

In some instances, an antibody or its binding fragment thereof is expressed recombinantly, and the nucleic acid encoding the antibody or its binding fragment is assembled from chemically synthesized oligonucleotides (e.g., as described in Kutmeier et al., 1994, BioTechniques 17:242), which involves the synthesis of overlapping oligonucleotides containing portions of the sequence encoding the antibody, annealing and ligation of those oligonucleotides, and then amplification of the ligated oligonucleotides by PCR.

Alternatively, a nucleic acid molecule encoding an antibody is optionally generated from a suitable source (e.g., an antibody cDNA library, or cDNA library generated from any tissue or cells expressing the immunoglobulin) by PCR amplification using synthetic primers hybridizable to the 3' and 5' ends of the sequence or by cloning using an oligonucleotide probe specific for the particular gene sequence.

In some instances, an antibody or its binding is optionally generated by immunizing an animal, such as a rabbit, to generate polyclonal antibodies or, more preferably, by generating monoclonal antibodies, e.g., as described by Kohler and Milstein (1975, Nature 256:495-497) or, as described by Kozbor et al. (1983, Immunology Today 4:72) or Cole et al. (1985 in Monoclonal Antibodies and Cancer Therapy, Alan R. Liss, Inc., pp. 77-96). Alternatively, a clone encoding at least the Fab portion of the antibody is optionally obtained by screening Fab expression libraries (e.g., as described in Huse et al., 1989, Science 246:1275-1281) for clones of Fab fragments that bind the specific antigen or by screening antibody libraries (See, e.g., Clackson et al., 1991, Nature 352:624; Hane et al., 1997 Proc. Natl. Acad. Sci. USA 94:4937).

In some embodiments, techniques developed for the production of "chimeric antibodies" (Morrison et al., 1984, Proc. Natl. Acad. Sci. 81:851-855; Neuberger et al., 1984, Nature 312:604-608; Takeda et al., 1985, Nature 314:452-454) by splicing genes from a mouse antibody molecule of appropriate antigen specificity together with genes from a human antibody molecule of appropriate biological activity are used. A chimeric antibody is a molecule in which different portions are derived from different animal species, such as those having a variable region derived from a murine monoclonal antibody and a human immunoglobulin constant region, e.g., humanized antibodies.

In some embodiments, techniques described for the production of single chain antibodies (U.S. Pat. No. 4,694,778; Bird, 1988, Science 242:423-42; Huston et al., 1988, Proc. Natl. Acad. Sci. USA 85:5879-5883; and Ward et al., 1989, Nature 334:544-54) are adapted to produce single chain antibodies. Single chain antibodies are formed by linking the heavy and light chain fragments of the Fv region via an amino acid bridge, resulting in a single chain polypeptide. Techniques for the assembly of functional Fv fragments in E. coli are also optionally used (Skerra et al., 1988, Science 242:1038-1041).

In some embodiments, an expression vector comprising the nucleotide sequence of an antibody or the nucleotide sequence of an antibody is transferred to a host cell by conventional techniques (e.g., electroporation, liposomal transfection, and calcium phosphate precipitation), and the transfected cells are then cultured by conventional techniques to produce the antibody. In specific embodiments, the expression of the antibody is regulated by a constitutive, an inducible or a tissue, specific promoter.

In some embodiments, a variety of host-expression vector systems is utilized to express an antibody or its binding fragment described herein. Such host-expression systems represent vehicles by which the coding sequences of the antibody is produced and subsequently purified, but also represent cells that are, when transformed or transfected with the appropriate nucleotide coding sequences, express an antibody or its binding fragment in situ. These include, but are not limited to, microorganisms such as bacteria (e.g., E. coli and B. subtilis) transformed with recombinant bacteriophage DNA, plasmid DNA or cosmid DNA expression vectors containing an antibody or its binding fragment coding sequences; yeast (e.g., Saccharomyces Pichia) transformed with recombinant yeast expression vectors containing an antibody or its binding fragment coding sequences; insect cell systems infected with recombinant virus expression vectors (e.g., baculovirus) containing an antibody or its binding fragment coding sequences; plant cell systems infected with recombinant virus expression vectors (e.g., cauliflower mosaic virus (CaMV) and tobacco mosaic virus (TMV)) or transformed with recombinant plasmid expression vectors (e.g., Ti plasmid) containing an antibody or its binding fragment coding sequences; or mammalian cell systems (e.g., COS, CHO, BH, 293, 293T, 3T3 cells) harboring recombinant expression constructs containing promoters derived from the genome of mammalian cells (e.g., metallothionein promoter) or from mammalian viruses (e.g. the adenovirus late promoter; the vaccinia virus 7.5K promoter).

For long-term, high-yield production of recombinant proteins, stable expression is preferred. In some instances, cell lines that stably express an antibody are optionally engineered. Rather than using expression vectors that contain viral origins of replication, host cells are transformed with DNA controlled by appropriate expression control elements (e.g., promoter, enhancer, sequences, transcription terminators, polyadenylation sites, etc.), and a selectable marker. Following the introduction of the foreign DNA, engineered cells are then allowed to grow for 1-2 days in an enriched media, and then are switched to a selective media. The selectable marker in the recombinant plasmid confers resistance to the selection and allows cells to stably integrate the plasmid into their chromosomes and grow to form foci that in turn are cloned and expanded into cell lines. This method can advantageously be used to engineer cell lines which express the antibody or its binding fragments.

In some instances, a number of selection systems are used, including but not limited to the herpes simplex virus thymidine kinase (Wigler et al., 1977, *Cell* 11:223), hypoxanthine-guanine phosphoribosyltransferase (Szybalska & Szybalski, 192, *Proc. Natl. Acad. Sci. USA* 48:202), and adenine phosphoribosyltransferase (Lowy et al., 1980, *Cell* 22:817) genes are employed in tk–, hgprt– or aprt– cells, respectively. Also, antimetabolite resistance are used as the basis of selection for the following genes: dhfr, which confers resistance to methotrexate (Wigler et al., 1980, *Proc. Natl. Acad. Sci. USA* 77:357; O'Hare et al., 1981, *Proc. Natl. Acad. Sci. USA* 78:1527); gpt, which confers resistance to mycophenolic acid (Mulligan & Berg, 1981, *Proc. Natl. Acad. Sci. USA* 78:2072); neo, which confers resistance to the aminoglycoside G-418 (Clinical Pharmacy 12:488-505; Wu and Wu, 1991, *Biotherapy* 3:87-95; Tolstoshev, 1993, *Ann. Rev. Pharmacol. Toxicol.* 32:573-596; Mulligan, 1993, *Science* 260:926-932; and Morgan and Anderson, 1993, *Ann. Rev. Biochem.* 62:191-217; May, 1993, *TIB TECH* 11(5):155-215) and hygro, which confers resistance to hygromycin (Santerre et al., 1984, *Gene* 30:147). Methods commonly known in the art of recombinant DNA technology which can be used are described in Ausubel et al. (eds., 1993, *Current Protocols in Molecular Biology*, John Wiley & Sons, NY; Kriegler, 1990, *Gene Transfer and Expression, A Laboratory Manual*, Stockton Press, NY; and in Chapters 12 and 13, Dracopoli et al. (eds), 1994, *Current Protocols in Human Genetics*, John Wiley & Sons, NY.; Colberre-Garapin et al., 1981, *J. Mol. Biol.* 150:1).

In some instances, the expression levels of an antibody are increased by vector amplification (for a review, see Bebbington and Hentschel, *The use of vectors based on gene amplification for the expression of cloned genes in mammalian cells in DNA cloning*, Vol. 3. (Academic Press, New York, 1987)). When a marker in the vector system expressing an antibody is amplifiable, an increase in the level of inhibitor present in culture of host cell will increase the number of copies of the marker gene. Since the amplified region is associated with the nucleotide sequence of the antibody, production of the antibody will also increase (Crouse et al., 1983, *Mol. Cell Biol.* 3:257).

In some instances, any method known in the art for purification of an antibody is used, for example, by chromatography (e.g., ion exchange, affinity, particularly by affinity for the specific antigen after Protein A, and sizing column chromatography), centrifugation, differential solubility, or by any other standard technique for the purification of proteins.

Polymer Conjugating Moiety

In some embodiments, a polymer moiety C is further conjugated to a polynucleic acid molecule described herein, a binding moiety described herein, or in combinations thereof. In some instances, a polymer moiety C is conjugated a polynucleic acid molecule. In some cases, a polymer moiety C is conjugated to a binding moiety. In other cases, a polymer moiety C is conjugated to a polynucleic acid molecule-binding moiety molecule. In additional cases, a polymer moiety C is conjugated, as illustrated in FIG. 1, and as discussed under the Therapeutic Molecule Platform section.

In some instances, the polymer moiety C is a natural or synthetic polymer, consisting of long chains of branched or unbranched monomers, and/or cross-linked network of monomers in two or three dimensions. In some instances, the polymer moiety C includes a polysaccharide, lignin, rubber, or polyalkylen oxide (e.g., polyethylene glycol). In some instances, the at least one polymer moiety C includes, but is not limited to, alpha-, omega-dihydroxylpolyethyleneglycol, biodegradable lactone-based polymer, e.g. polyacrylic acid, polylactide acid (PLA), poly(glycolic acid) (PGA), polypropylene, polystyrene, polyolefin, polyamide, polycyanoacrylate, polyimide, polyethylenterephthalat (PET, PETG), polyethylene terephthalate (PETE), polytetramethylene glycol (PTG), or polyurethane as well as mixtures thereof. As used herein, a mixture refers to the use of different polymers within the same compound as well as in reference to block copolymers. In some cases, block copolymers are polymers wherein at least one section of a polymer is build up from monomers of another polymer. In some instances, the polymer moiety C comprises polyalkylene oxide. In some instances, the polymer moiety C comprises PEG. In some instances, the polymer moiety C comprises polyethylene imide (PEI) or hydroxy ethyl starch (HES).

In some instances, C is a PEG moiety. In some instances, the PEG moiety is conjugated at the 5' terminus of the polynucleic acid molecule while the binding moiety is conjugated at the 3' terminus of the polynucleic acid molecule. In some instances, the PEG moiety is conjugated at the 3' terminus of the polynucleic acid molecule while the binding moiety is conjugated at the 5' terminus of the polynucleic acid molecule. In some instances, the PEG moiety is conjugated to an internal site of the polynucleic acid molecule. In some instances, the PEG moiety, the binding moiety, or a combination thereof, are conjugated to an internal site of the polynucleic acid molecule. In some instances, the conjugation is a direct conjugation. In some instances, the conjugation is via native ligation.

In some embodiments, the polyalkylene oxide (e.g., PEG) is a polydispers or monodispers compound. In some instances, polydispers material comprises disperse distribution of different molecular weight of the material, characterized by mean weight (weight average) size and dispersity. In some instances, the monodisperse PEG comprises one size of molecules. In some embodiments, C is poly- or monodispersed polyalkylene oxide (e.g., PEG) and the indicated molecular weight represents an average of the molecular weight of the polyalkylene oxide, e.g., PEG, molecules.

In some embodiments, the molecular weight of the polyalkylene oxide (e.g., PEG) is about 200, 300, 400, 500, 600, 700, 800, 900, 1000, 1100, 1200, 1300, 1400, 1450, 1500, 1600, 1700, 1800, 1900, 2000, 2100, 2200, 2300, 2400, 2500, 2600, 2700, 2800, 2900, 3000, 3250, 3350, 3500, 3750, 4000, 4250, 4500, 4600, 4750, 5000, 5500, 6000, 6500, 7000, 7500, 8000, 10,000, 12,000, 20,000, 35,000, 40,000, 50,000, 60,000, or 100,000 Da.

In some embodiments, C is polyalkylene oxide (e.g., PEG) and has a molecular weight of about 200, 300, 400, 500, 600, 700, 800, 900, 1000, 1100, 1200, 1300, 1400, 1450, 1500, 1600, 1700, 1800, 1900, 2000, 2100, 2200, 2300, 2400, 2500, 2600, 2700, 2800, 2900, 3000, 3250, 3350, 3500, 3750, 4000, 4250, 4500, 4600, 4750, 5000, 5500, 6000, 6500, 7000, 7500, 8000, 10,000, 12,000, 20,000, 35,000, 40,000, 50,000, 60,000, or 100,000 Da. In some embodiments, C is PEG and has a molecular weight of about 200, 300, 400, 500, 600, 700, 800, 900, 1000, 1100, 1200, 1300, 1400, 1450, 1500, 1600, 1700, 1800, 1900, 2000, 2100, 2200, 2300, 2400, 2500, 2600, 2700, 2800, 2900, 3000, 3250, 3350, 3500, 3750, 4000, 4250, 4500, 4600, 4750, 5000, 5500, 6000, 6500, 7000, 7500, 8000, 10,000, 12,000, 20,000, 35,000, 40,000, 50,000, 60,000, or 100,000 Da. In some instances, the molecular weight of C is about 200 Da. In some instances, the molecular weight of C is about 300 Da. In some instances, the molecular weight of C is about 400 Da. In some instances, the molecular weight of C is about 500 Da. In some instances, the molecular weight of C is about 600 Da. In some instances, the molecular weight of C is about 700 Da. In some instances, the molecular weight of C is about 800 Da. In some instances, the molecular weight of C is about 900 Da. In some instances, the molecular weight of C is about 1000 Da. In some instances, the molecular weight of C is about 1100 Da. In some instances, the molecular weight of C is about 1200 Da. In some instances, the molecular weight of C is about 1300 Da. In some instances, the molecular weight of C is about 1400 Da. In some instances, the molecular weight of C is about 1450 Da. In some instances, the molecular weight of C is about 1500 Da. In some instances, the molecular weight of C is about 1600 Da. In some instances, the molecular weight of C is about 1700 Da. In some instances, the molecular weight of C is about 1800 Da. In some instances, the molecular weight of C is about 1900 Da. In some instances, the molecular weight of C is about 2000 Da. In some instances, the molecular weight of C is about 2100 Da. In some instances, the molecular weight of C is about 2200 Da. In some instances, the molecular weight of C is about 2300 Da. In some instances, the molecular weight of C is about 2400 Da. In some instances, the molecular weight of C is about 2500 Da. In some instances, the molecular weight of C is about 2600 Da. In some instances, the molecular weight of C is about 2700 Da. In some instances, the molecular weight of C is about 2800 Da. In some instances, the molecular weight of C is about 2900 Da. In some instances, the molecular weight of C is about 3000 Da. In some instances, the molecular weight of C is about 3250 Da. In some instances, the molecular weight of C is about 3350 Da. In some instances, the molecular weight of C is about 3500 Da. In some instances, the molecular weight of C is about 3750 Da. In some instances, the molecular weight of C is about 4000 Da. In some instances, the molecular weight of C is about 4250 Da. In some instances, the molecular weight of C is about 4500 Da. In some instances, the molecular weight of C is about 4600 Da. In some instances, the molecular weight of C is about 4750 Da. In some instances, the molecular weight of C is about 5000 Da. In some instances, the molecular weight of C is about 5500 Da. In some instances, the molecular weight of C is about 6000 Da. In some instances, the molecular weight of C is about 6500 Da. In some instances, the molecular weight of C is about 7000 Da. In some instances, the molecular weight of C is about 7500 Da. In some instances, the molecular weight of C is about 8000 Da. In some instances, the molecular weight of C is about 10,000 Da. In some instances, the molecular weight of C is about 12,000 Da. In some instances, the molecular weight of C is about 20,000 Da. In some instances, the molecular weight of C is about 35,000 Da. In some instances, the molecular weight of C is about 40,000 Da. In some instances, the molecular weight of C is about 50,000 Da. In some instances, the molecular weight of C is about 60,000 Da. In some instances, the molecular weight of C is about 100,000 Da.

In some embodiments, the polyalkylene oxide (e.g., PEG) is a discrete PEG, in which the discrete PEG is a polymeric PEG comprising more than one repeating ethylene oxide units. In some instances, a discrete PEG (dPEG) comprises from 2 to 60, from 2 to 50, or from 2 to 48 repeating ethylene oxide units. In some instances, a dPEG comprises about 2, 3, 4, 5, 6, 7, 8, 9, 10, 11, 12, 13, 14, 15, 16, 17, 18, 19, 20, 22, 24, 26, 28, 30, 35, 40, 42, 48, 50 or more repeating ethylene oxide units. In some instances, a dPEG comprises about 2 or more repeating ethylene oxide units. In some instances, a dPEG comprises about 3 or more repeating ethylene oxide units. In some instances, a dPEG comprises about 4 or more repeating ethylene oxide units. In some instances, a dPEG comprises about 5 or more repeating ethylene oxide units. In some instances, a dPEG comprises about 6 or more repeating ethylene oxide units. In some instances, a dPEG comprises about 7 or more repeating ethylene oxide units. In some instances, a dPEG comprises about 8 or more repeating ethylene oxide units. In some instances, a dPEG comprises about 9 or more repeating ethylene oxide units. In some instances, a dPEG comprises about 10 or more repeating ethylene oxide units. In some instances, a dPEG comprises about 11 or more repeating ethylene oxide units. In some instances, a dPEG comprises about 12 or more repeating ethylene oxide units. In some instances, a dPEG comprises about 13 or more repeating ethylene oxide units. In some instances, a dPEG comprises about 14 or more repeating ethylene oxide units. In some instances, a dPEG comprises about 15 or more repeating ethylene oxide units. In some instances, a dPEG comprises about 16 or more repeating ethylene oxide units. In some instances, a dPEG comprises about 17 or more repeating ethylene oxide units. In some instances, a dPEG comprises about 18 or more repeating ethylene oxide units. In some instances, a dPEG comprises about 19 or more repeating ethylene oxide units. In some instances, a dPEG comprises about 20 or more repeating ethylene oxide units. In some instances, a dPEG comprises about 22 or more repeating ethylene oxide units. In some instances, a dPEG comprises about 24 or more repeating ethylene oxide units. In some instances, a dPEG comprises about 26 or more repeating ethylene oxide units. In some instances, a dPEG comprises about 28 or more repeating ethylene oxide units. In some instances, a dPEG comprises about 30 or more repeating ethylene oxide units. In some instances, a dPEG comprises about 35 or more repeating ethylene oxide units. In some instances, a dPEG comprises about 40 or more repeating ethylene oxide units. In some instances, a dPEG comprises about 42 or more repeating ethylene oxide units. In some instances, a dPEG comprises about 48 or more repeating ethylene oxide units. In some instances, a dPEG comprises about 50 or more repeating ethylene oxide units. In some cases, a dPEG is synthesized as a single molecular weight compound from pure (e.g., about 95%, 98%, 99%, or 99.5%) staring material in a step-wise fashion. In some cases, a dPEG has a specific molecular weight, rather than an average molecular weight. In some cases, a dPEG described herein is a dPEG from Quanta Biodesign, LMD.

In some embodiments, the polymer moiety C comprises a cationic mucic acid-based polymer (cMAP). In some instances, cMPA comprises one or more subunit of at least one repeating subunit, and the subunit structure is represented as Formula (III):

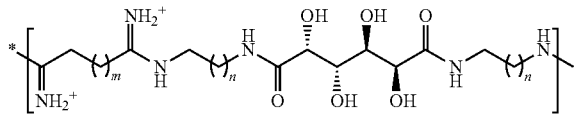

Formula III wherein m is independently at each occurrence 1, 2, 3, 4, 5, 6, 7, 8, 9, or 10, preferably 4-6 or 5; and n is independently at each occurrence 1, 2, 3, 4, or 5. In some embodiments, m and n are, for example, about 10.

In some instances, cMAP is further conjugated to a PEG moiety, generating a cMAP-PEG copolymer, an mPEG-cMAP-PEGm triblock polymer, or a cMAP-PEG-cMAP triblock polymer. In some instances, the PEG moiety is in a range of from about 500 Da to about 50,000 Da. In some instances, the PEG moiety is in a range of from about 500 Da to about 1000 Da, greater than 1000 Da to about 5000 Da, greater than 5000 Da to about 10,000 Da, greater than 10,000 to about 25,000 Da, greater than 25,000 Da to about 50,000 Da, or any combination of two or more of these ranges.

In some instances, the polymer moiety C is cMAP-PEG copolymer, an mPEG-cMAP-PEGm triblock polymer, or a cMAP-PEG-cMAP triblock polymer. In some cases, the polymer moiety C is cMAP-PEG copolymer. In other cases, the polymer moiety C is an mPEG-cMAP-PEGm triblock polymer. In additional cases, the polymer moiety C is a cMAP-PEG-cMAP triblock polymer.

In some embodiments, the polymer moiety C is conjugated to the polynucleic acid molecule, the binding moiety, and optionally to the endosomolytic moiety as illustrated in FIG. 1.

Endosomolytic Moiety

In some embodiments, a molecule of Formula (I): A-X—B—Y—C, further comprises an additional conjugating moiety. In some instances, the additional conjugating moiety is an endosomolytic moiety. In some cases, the endosomolytic moiety is a cellular compartmental release component, such as a compound capable of releasing from any of the cellular compartments known in the art, such as the endosome, lysosome, endoplasmic reticulum (ER), golgi apparatus, microtubule, peroxisome, or other vesicular bodies with the cell. In some cases, the endosomolytic moiety comprises an endosomolytic polypeptide, an endosomolytic polymer, an endosomolytic lipid, or an endosomolytic small molecule. In some cases, the endosomolytic moiety comprises an endosomolytic polypeptide. In other cases, the endosomolytic moiety comprises an endosomolytic polymer.

Endosomolytic Polypeptides

In some embodiments, a molecule of Formula (1): A-X—B—Y—C, is further conjugated with an endosomolytic polypeptide. In some cases, the endosomolytic polypeptide is a pH-dependent membrane active peptide. In some cases, the endosomolytic polypeptide is an amphipathic polypeptide. In additional cases, the endosomolytic polypeptide is a peptidomimetic. In some instances, the endosomolytic polypeptide comprises INF, melittin, meucin, or their respective derivatives thereof. In some instances, the endosomolytic polypeptide comprises INF or its derivatives thereof. In other cases, the endosomolytic polypeptide comprises melittin or its derivatives thereof. In additional cases, the endosomolytic polypeptide comprises meucin or its derivatives thereof.

In some instances, INF7 is a 24 residue polypeptide those sequence comprises CGIFGEIEELIEEGLENLIDWGNA (SEQ ID NO: 2055), or GLFEAIEGFIENGWEGMIDG-WYGC (SEQ ID NO: 2056). In some instances, INF7 or its derivatives comprise a sequence of:

```
                                    (SEQ ID NO: 2057)
GLFEAIEGFIENGWEGMIWDYGSGSCG, (SEQ ID NO: 2058)
GLFEAIEGFIENGWEGMIDG WYG-(PEG)6-NH2,
``` or

```
                                    (SEQ ID NO: 2059)
GLFEAIEGFIENGWEGMIWDYG-SGSC-K(GalNAc)2.
```

In some cases, melittin is a 26 residue polypeptide those sequence comprises CLIGAILKVLATGLPTLISWIKNK-RKQ (SEQ ID NO: 2060), or GIGAVLKVLTTGLPAL-ISWIKRKRQQ (SEQ ID NO: 2061). In some instances, melittin comprises a polypeptide sequence as described in U.S. Pat. No. 8,501,930.

In some instances, meucin is an antimicrobial peptide (AMP) derived from the venom gland of the scorpion Mesobuthus eupeus. In some instances, meucin comprises of meucin-13 those sequence comprises IFGAIAGLLKNIF-NH2 (SEQ ID NO: 2062) and meucin-18 those sequence comprises FFGHLFKLATKIIPSLFQ (SEQ ID NO: 2063).

In some instances, the endosomolytic polypeptide comprises a polypeptide in which its sequence is at least 50%, 60%, 70%, 80%, 90%, 95%, or 99% sequence identity to INF7 or its derivatives thereof, melittin or its derivatives thereof, or meucin or its derivatives thereof. In some instances, the endosomolytic moiety comprises INF7 or its derivatives thereof, melittin or its derivatives thereof, or meucin or its derivatives thereof.

In some instances, the endosomolytic moiety is INF7 or its derivatives thereof. In some cases, the endosomolytic moiety comprises a polypeptide having at least 50%, 55%, 60%, 65%, 70%, 75%, 80%, 85%, 90%, 95%, 96%, 97%, 98%, 99%, or 100% sequence identity to SEQ ID NOs: 2055-2059. In some cases, the endosomolytic moiety comprises a polypeptide having at least 50%, 55%, 60%, 65%, 70%, 75%, 80%, 85%, 90%, 95%, 96%, 97%, 98%, 99%, or 100% sequence identity to SEQ ID NO: 2055. In some cases, the endosomolytic moiety comprises a polypeptide having at least 50%, 55%, 60%, 65%, 70%, 75%, 80%, 85%, 90%, 95%, 96%, 97%, 98%, 99%, or 100% sequence identity to SEQ ID NO: 2056-2059. In some cases, the endosomolytic moiety comprises SEQ ID NO: 2055. In some cases, the endosomolytic moiety comprises SEQ ID NO: 2056-2059. In some cases, the endosomolytic moiety consists of SEQ ID NO: 2055. In some cases, the endosomolytic moiety consists of SEQ ID NO: 2056-2059.

In some instances, the endosomolytic moiety is melittin or its derivatives thereof. In some cases, the endosomolytic moiety comprises a polypeptide having at least 50%, 55%, 60%, 65%, 70%, 75%, 80%, 85%, 90%, 95%, 96%, 97%, 98%, 99%, or 100% sequence identity to SEQ ID NOs: 2060 or 2061. In some cases, the endosomolytic moiety comprises a polypeptide having at least 50%, 55%, 60%, 65%, 70%, 75%, 80%, 85%, 90%, 95%, 96%, 97%, 98%, 99%, or 100% sequence identity to SEQ ID NO: 2060. In some cases, the endosomolytic moiety comprises a polypeptide having at least 50%, 55%, 60%, 65%, 70%, 75%, 80%, 85%, 90%, 95%, 96%, 97%, 98%, 99%, or 100% sequence identity to SEQ ID NO: 2061. In some cases, the endosomolytic moiety comprises SEQ ID NO: 2060. In some cases, the endosomolytic moiety comprises SEQ ID NO: 2061. In some cases, the endosomolytic moiety consists of SEQ ID NO: 2060. In some cases, the endosomolytic moiety consists of SEQ ID NO: 2061.

In some instances, the endosomolytic moiety is meucin or its derivatives thereof. In some cases, the endosomolytic moiety comprises a polypeptide having at least 50%, 55%, 60%, 65%, 70%, 75%, 80%, 85%, 90%, 95%, 96%, 97%, 98%, 99%, or 100% sequence identity to SEQ ID NOs: 2062 or 2063. In some cases, the endosomolytic moiety comprises a polypeptide having at least 50%, 55%, 60%, 65%, 70%, 75%, 80%, 85%, 90%, 95%, 96%, 97%, 98%, 99%, or 100% sequence identity to SEQ ID NO: 2062. In some cases, the endosomolytic moiety comprises a polypeptide having at least 50%, 55%, 60%, 65%, 70%, 75%, 80%, 85%, 90%, 95%, 96%, 97%, 98%, 99%, or 100% sequence identity to SEQ ID NO: 2063. In some cases, the endosomolytic moiety comprises SEQ ID NO: 2062. In some cases, the endosomolytic moiety comprises SEQ ID NO: 2063. In some cases, the endosomolytic moiety consists of SEQ ID NO: 2062. In some cases, the endosomolytic moiety consists of SEQ ID NO: 2063.

In some instances, the endosomolytic moiety comprises a sequence as illustrated in Table 62.

TABLE 62

| Name | Origin | Amino Acid Sequence | SEQ ID NO: | Type |
|---|---|---|---|---|
| Pep-1 | NLS from Simian Virus 40 large antigen and Reverse transcriptase of HIV | KETWWETWWTEWSQPKKKRKV | 2064 | Primary amphipathic |
| pVEC | VE-cadherin | LLIILRRRRIRKQAHAHSK | 2065 | Primary amphipathic |
| VT5 | Synthetic peptide | DPKGDPKGVTVTVTVTGKGDPKPD | 2066 | β-sheet amphipathic |
| C105Y | 1-antitrypsin | CSIPPEVKFNKPFVYLI | 2067 | — |
| Transportan | Galanin and mastoparan | GWTLNSAGYLLGKINLKALAALAKKIL | 2068 | Primary amphipathic |
| TP10 | Galanin and mastoparan | AGYLLGKINLKALAALAKKIL | 2069 | Primary amphipathic |
| MPG | A hydrofobic domain from the fusion sequence of HIV gp41 and NLS of SV40 T antigen | GALFLGFLGAAGSTMGA | 2070 | β-sheet amphipathic |
| gH625 | Glycoprotein gH of HSV type I | HGLASTLTRWAHYNALIRAF | 2071 | Secondary amphipathic α-helical |
| CADY | PPTG1 peptide | GLWRALWRLLRSLWRLLWRA | 2072 | Secondary amphipathic α-helical |
| GALA | Synthetic peptide | WEAALAEALAEALAEHLAEALAEALEALAA | 2073 | Secondary amphipathic α-helical |
| INF | Influenza HA2 fusion peptide | GLFEAIEGFIENGWEGMIDGWYGC | 2074 | Secondary amphipathic α-helical/ pH-dependent membrane active peptide |
| HA2E5-TAT | Influenza HA2 subunit of influenza virus X31 strain fusion peptide | GLFGAIAGFIENGWEGMIDGWYG | 2075 | Secondary amphipathic α-helical/ pH-dependent membrane active peptide |
| HA2-penetratin | Influenza HA2 subunit of influenza virus X31 strain fusion peptide | GLFGAIAGFIENGWEGMIDGRQIKIWFQNRRMKWKK-amide | 2076 | pH-dependent membrane active peptide |
| HA-K4 | Influenza HA2 subunit of influenza virus X31 strain fusion peptide | GLFGAIAGFIENGWEGMIDG-SSKKKK | 2077 | pH-dependent membrane active peptide |

TABLE 62-continued

| Name | Origin | Amino Acid Sequence | SEQ ID NO: | Type |
|---|---|---|---|---|
| HA2E4 | Influenza HA2 subunit of influenza virus X31 strain fusion peptide | GLFEAIAGFIENGWEGMIDGGGYC | 2078 | pH-dependent membrane active peptide |
| H5WYG | HA2 analogue | GLFHAIAHFIHGGWH GLIHGWYG | 2079 | pH-dependent membrane active peptide |
| GALA-INF3-(PEG)6-NH | INF3 fusion peptide | GLFEAIEGFIENGWEGLAEALAEAL EALAA-(PEG)6-NH2 | 2080 | pH-dependent membrane active peptide |
| CM18-TAT11 | Cecropin-A-Melittin$_{2-12}$ (CM$_{18}$) fusion peptide | KWKLFKKIGAVLKVLTTG-YGRKKRRQRRR | 2081 | pH-dependent membrane active peptide |

In some cases, the endosomolytic moiety comprises a Bak BH3 polypeptide which induces apoptosis through antagonization of suppressor targets such as Bcl-2 and/or Bcl-x$_L$. In some instances, the endosomolytic moiety comprises a Bak BH3 polypeptide described in Albarran, et al., "Efficient intracellular delivery of a pro-apoptotic peptide with a pH-responsive carrier," *Reactive & Functional Polymers* 71: 261-265 (2011).

In some instances, the endosomolytic moiety comprises a polypeptide (e.g., a cell-penetrating polypeptide) as described in PCT Publication Nos. WO2013/166155 or WO2015/069587.

Endosomolytic Polymers

In some embodiments, a molecule of Formula (I): A-X—B—Y—C, is further conjugated with an endosomolytic polymer. As used herein, an endosomolytic polymer comprises a linear, a branched network, a star, a comb, or a ladder type of polymer. In some instances, an endosomolytic polymer is a homopolymer or a copolymer comprising two or more different types of monomers. In some cases, an endosomolytic polymer is a polycation polymer. In other cases, an endosomolytic polymer is a polyanion polymer.

In some instances, a polycation polymer comprises monomer units that are charge positive, charge neutral, or charge negative, with a net charge being positive. In other cases, a polycation polymer comprises a non-polymeric molecule that contains two or more positive charges. Exemplary cationic polymers include, but are not limited to, poly(L-lysine) (PLL), poly(L-arginine) (PLA), polyethyleneimine (PEI), poly[α-(4-aminobutyl)-L-glycolic acid] (PAGA), 2-(dimethylamino)ethyl methacrylate (DMAEMA), or N,N-Diethylaminoethyl Methacrylate (DEAEMA).

In some cases, a polyanion polymer comprises monomer units that are charge positive, charge neutral, or charge negative, with a net charge being negative. In other cases, a polyanion polymer comprises a non-polymeric molecule that contains two or more negative charges. Exemplary anionic polymers include p(alkylacrylates) (e.g., poly(propyl acrylic acid) (PPAA)) or poly(N-isopropylacrylamide) (NIPAM). Additional examples include PP75, a L-phenyl-alanine-poly(L-lysine isophthalamide) polymer described in Khormaee, et al., "Edosomolytic anionic polymer for the cytoplasmic delivery of siRNAs in localized in vivo applications," *Advanced Functional Materials* 23: 565-574 (2013).

In some embodiments, an endosomolytic polymer described herein is a pH-responsive endosomolytic polymer. A pH-responsive polymer comprises a polymer that increases in size (swell) or collapses depending on the pH of the environment. Polyacrylic acid and chitosan are examples of pH-responsive polymers.

In some instances, an endosomolytic moiety described herein is a membrane-disruptive polymer. In some cases, the membrane-disruptive polymer comprises a cationic polymer, a neutral or hydrophobic polymer, or an anionic polymer. In some instances, the membrane-disruptive polymer is a hydrophilic polymer.

In some instances, an endosomolytic moiety described herein is a pH-responsive membrane-disruptive polymer. Exemplary pH-responsive membrane-disruptive polymers include p(alkylacrylic acids), poly(N-isopropylacrylamide) (NIPAM) copolymers, succinylated p(glycidols), and p(β-malic acid) polymers.

In some instances, p(alkylacrylic acids) include poly (propylacrylic acid) (polyPAA), poly(methacrylic acid) (PMAA), poly(ethylacrylic acid) (PEAA), and poly(propyl acrylic acid) (PPAA). In some instances, a p(alkylacrylic acid) include a p(alkylacrylic acid) described in Jones, et al., *Biochemistry Journal* 372: 65-75 (2003).

In some embodiments, a pH-responsive membrane-disruptive polymer comprises p(butyl acrylate-co-methacrylic acid). (see Bulmus, et al., Journal of Controlled Release 93: 105-120 (2003); and Yessine, et al., *Biochimica et Biophysica Acta* 1613: 28-38 (2003))

In some embodiments, a pH-responsive membrane-disruptive polymer comprises p(styrene-alt-maleic anhydride). (see Henry, et al., *Biomacromolecules* 7: 2407-2414 (2006))

In some embodiments, a pH-responsive membrane-disruptive polymer comprises pyridyldisulfide acrylate (PDSA) polymers such as poly(MAA-co-PDSA), poly(EAA-co- PDSA), poly(PAA-co-PDSA), poly(MAA-co-BA-co-PDSA), poly(EAA-co-BA-co-PDSA), or poly(PAA-co-BA-co-PDSA) polymers. (see El-Sayed, et al., "Rational design of composition and activity correlations for pH-responsive and glutathione-reactive polymer therapeutics," *Journal of Controlled Release* 104: 417-427 (2005); or Flanary et al., "Antigen delivery with poly(propylacrylic acid) conjugation enhanced MHC-1 presentation and T-cell activation," *Bioconjugate Chem.* 20: 241-248 (2009))

In some embodiments, a pH-responsive membrane-disruptive polymer comprises a lytic polymer comprising the base structure of:

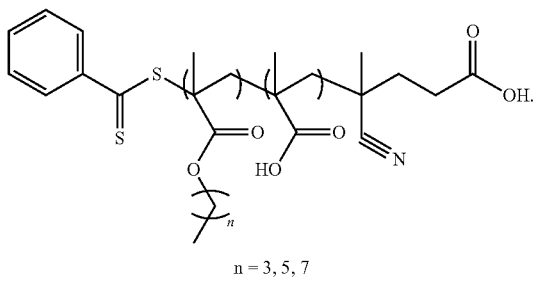

n = 3, 5, 7

In some instances, an endosomolytic moiety described herein is further conjugated to an additional conjugate, e.g., a polymer (e.g., PEG), or a modified polymer (e.g., cholesterol-modified polymer).

In some instances, the additional conjugate comprises a detergent (e.g., Triton X-100). In some instances, an endosomolytic moiety described herein comprises a polymer (e.g., a poly(amidoamine)) conjugated with a detergent (e.g., Triton X-100). In some instances, an endosomolytic moiety described herein comprises poly(amidoamine)-Triton X-100 conjugate (Duncan, et al., "A polymer-Triton X-100 conjugate capable of pH-dependent red blood cell lysis: a model system illustrating the possibility of drug delivery within acidic intracellular compartments,"*Journal of Drug Targeting* 2: 341-347 (1994)).

Endosomolytic Lipids

In some embodiments, the endosomolytic moiety is a lipid (e.g., a fusogenic lipid). In some embodiments, a molecule of Formula (I): A-X—B—Y—C, is further conjugated with an endosomolytic lipid (e.g., fusogenic lipid). Exemplary fusogenic lipids include 1,2-dileoyl-sn-3-phosphoethanolamine (DOPE), phosphatidylethanolamine (POPE), palmitoyloleoylphosphatidylcholine (POPC), (6Z,9Z,28Z,31Z)-heptatriaconta-6,9,28,31-tetraen-19-ol (Di-Lin), N-methyl(2,2-di((9Z,12Z)-octadeca-9,12-dienyl)-1,3-dioxolan-4-yl)methanamine (DLin-k-DMA) and N-methyl-2-(2,2-di((9Z,12Z)-octadeca-9,12-dienyl)-1,3-dioxolan-4-yDethanamine (XTC).

In some instances, an endosomolytic moiety is a lipid (e.g., a fusogenic lipid) described in PCT Publication No. WO09/126,933.

Endosomolytic Small Molecules

In some embodiments, the endosomolytic moiety is a small molecule. In some embodiments, a molecule of Formula (I): A-X—B—Y—C, is further conjugated with an endosomolytic small molecule. Exemplary small molecules suitable as endosomolytic moieties include, but are not limited to, quinine, chloroquine, hydroxychloroquines, amodiaquins (carnoquines), amopyroquines, primaquines, mefloquines, nivaquines, halofantrines, quinone imines, or a combination thereof. In some instances, quinoline endosomolytic moieties include, but are not limited to, 7-chloro-4-(4-diethylamino-1-methyl butyl-amino)quinoline (chloroquine); 7-chloro-4-(4-ethyl-(2-hydroxyethyl)-amino-1-methylbutyl-amino)quinoline (hydroxychloroquine); 7-fluoro-4-(4-diethylamino-1-methylbutyl-amino)quinoline; 4-(4-diethylamino-1-methylbutylamino) quinoline; 7-hydroxy-4-(4-diethyl-amino-1-methylbutylamino)quinoline; 7-chloro-4-(4-diethylamino-1-butylamino)quinoline (desmethylchloroquine); 7-fluoro-4-(4-diethylamino-1-butylamino)quinoline); 4-(4-diethyl-amino-1-butylamino)quinoline; 7-hydroxy-4-(4-diethylamino-1-butylamino)quinoline; 7-chloro-4-(1-carboxy-4-diethylamino-1-butylamino) quinoline; 7-fluoro-4-(1-carboxy-4-diethyl-amino-1-butylamino)quinoline; 4-(1-carboxy-4-diethylamino-1-butylamino) quinoline; 7-hydroxy-4-(1-carboxy-4-diethylamino-1-butylamino)quinoline; 7-chloro-4-(1-carboxy-4-diethylamino-1-methylbutylamino)quinoline; 7-fluoro-4-(1-carboxy-4-diethyl-amino-1-methylbutylamino)quinoline; 4-(1-carboxy-4-diethylamino-1-methylbutylamino)quinoline; 7-hydroxy-4-(1-carboxy-4-diethylamino-1-methylbutylamino)quinoline; 7-fluoro-4-(4-ethyl-(2-hydroxyethyl)-amino-1-methylbutylamino)quinoline; 4-(4-ethyl-(2-hydroxy-ethyl)-amino-1-methylbutylamino-)quinoline; 7-hydroxy-4-(4-ethyl-(2-hydroxyethyl)-amino-1-methylbutylamino)quinoline; hydroxychloroquine phosphate; 7-chloro-4-(4-ethyl-(2-hydroxyethyl-1)-amino-1-butylamino)quinoline (desmethylhydroxychloroquine); 7-fluoro-4-(4-ethyl-(2-hydroxyethyl)-amino-1-butylamino) quinoline; 4-(4-ethyl-(2-hydroxyethyl)-amino-1-butylamino)quinoline; 7-hydroxy-4-(4-ethyl-(2-hydroxyethyl)-amino-1-butylamino) quinoline; 7-chloro-4-(1-carboxy-4-ethyl-(2-hydroxyethyl)-amino-1-butylamino)quinoline; 7-fluoro-4-(1-carboxy-4-ethyl-(2-hydroxyethyl)-amino-1-butylamino)quinoline; 4-(1-carboxy-4-ethyl-(2-hydroxyethyl)-amino-1-butylamino)quinoline; 7-hydroxy-4-(1-carboxy-4-ethyl-(2-hydroxyethyl)-amino-1-butylamino) quinoline; 7-chloro-4-(1-carboxy-4-ethyl-(2-hydroxyethyl)-amino-1-methylbutylamino)quinoline; 7-fluoro-4-(1-carboxy-4-ethyl-(2-hydroxyethyl)-amino-1-methylbutylamino)quinoline; 4-(1-carboxy-4-ethyl-(2-hydroxyethyl)-amino-1-methylbutylamino)quinoline; 7-hydroxy-4-(1-carboxy-4-ethyl-(2-hydroxyethyl)-amino-1-methylbutylamino)quinoline; 8-[(4-aminopentyl)amino]-6-methoxydihydrochloride quinoline; 1-acetyl-1,2,3,4-tetrahydroquinoline; 8-[(4-aminopentyl)amino]-6-methoxyquinoline dihydrochloride; 1-butyryl-1,2,3,4-tetrahydroquinoline; 3-chloro-4-(4-hydroxy-alpha,alpha'-bis(2-methyl-1-pyrrolidinyl)-2,5-xylidinoquinoline, 4-[(4-diethyl-amino)-1-methylbutyl-amino]-6-methoxyquinoline; 3-fluoro-4-(4-hydroxy-alpha,alpha'-bis(2-methyl-1-pyrrolidinyl)-2,5-xylidinoquinoline, 4-[(4-diethylamino)-1-methylbutyl-amino]-6-methoxyquinoline; 4-(4-hydroxy-alpha,alpha'-bis(2-methyl-1-pyrrolidinyl)-2,5-xylidinoquinoline; 4-[(4-diethylamino)-1-methylbutyl-amino]-6-methoxyquinoline; 3,4-dihydro-1-(2H)-quinolinecarboxaldehyde; 1,1'-pentamethylene diquinoleinium diiodide; 8-quinolinol sulfate and amino, aldehyde, carboxylic, hydroxyl, halogen, keto, sulfhydryl and vinyl derivatives or analogs thereof. In some instances, an endosomolytic moiety is a small molecule described in Naisbitt et al (1997, J Pharmacol Exp Therapy 280:884-893) and in U.S. Pat. No. 5,736,557.

Formula (I) Molecule—Endosomolytic Moiety Conjugates

In some embodiments, one or more endosomolytic moieties are conjugated to a molecule comprising at least one binding moiety, at least one polynucleotide, at least one polymer, or any combinations thereof. In some instances, the endosomolytic moiety is conjugated according to Formula (II):

    Formula II wherein,
A is a binding moiety;
B is a polynucleotide;
C is a polymer;
X is a bond or first linker;
Y is a bond or second linker;
L is a bond or third linker;
D is an endosomolytic moiety; and
c is an integer between 0 and 1; and wherein the polynucleotide comprises at least one 2' modified nucleotide, at least one modified internucleotide linkage, or at least one inverted abasic moiety; and D is conjugated anywhere on A, B, or C.

In some embodiments, A and C are not attached to B at the same terminus.

In some embodiments, the at least one 2' modified nucleotide comprises 2'-O-methyl, 2'-O-methoxyethyl (2'-O-MOE), 2'-O-aminopropyl, 2'-deoxy, T-deoxy-2'-fluoro, 2'-O-aminopropyl (2'-O-AP), 2'-O-dimethylaminoethyl (2'-O-DMAOE), 2'-O-dimethylaminopropyl (2'-O-DMAP), T-O-dimethylaminoethyloxyethyl (2'-O-DMAEOE), or 2'-O—N-methylacetamido (2'-O-NMA) modified nucleotide. In some instances, the at least one 2' modified nucleotide comprises locked nucleic acid (LNA) or ethylene nucleic acid (ENA). In some cases, the at least one modified internucleotide linkage comprises a phosphorothioate linkage or a phosphorodithioate linkage. In some embodiments, the polynucleotide comprises a first polynucleotide and a second polynucleotide hybridized to the first polynucleotide to form a double-stranded polynucleic acid molecule. In some instances, the second polynucleotide comprises at least one modification. In some cases, the first polynucleotide and the second polynucleotide are RNA molecules. In some cases, the first polynucleotide and the second polynucleotide are siRNA molecules. In some embodiments, X, Y, and L are independently a bond or a non-polymeric linker group. In some instances, A is an antibody or binding fragment thereof. In some instances, the antibody or binding fragment thereof comprises a humanized antibody or binding fragment thereof, chimeric antibody or binding fragment thereof, monoclonal antibody or binding fragment thereof, monovalent Fab', divalent Fab2, single-chain variable fragment (scFv), diabody, minibody, nanobody, single-domain antibody (sdAb), or camelid antibody or binding fragment thereof. In some cases, C is polyethylene glycol.

In some instances, the endosomolytic moiety comprises a polypeptide, a polymer, a lipid, or a small molecule. In some instances, the endosomolytic moiety is an endosomolyticpolypeptide. In some cases, the endosomolytic moiety is an endosomolytic polymer. In other cases, the endosomolytic moiety is an endosomolytic lipid. In additional cases, the endosomolytic moiety is an endosomolytic small molecule.

In some instances, the endosomolytic moiety is INF7 or its derivatives thereof. In some cases, the endosomolytic moiety comprises a polypeptide having at least 50%, 55%, 60%, 65%, 70%, 75%, 80%, 85%, 90%, 95%, 96%, 97%, 98%, 99%, or 100% sequence identity to SEQ ID NOs: 2055. In some cases, the endosomolytic moiety comprises SEQ ID NO: 2055. In some cases, the endosomolytic moiety consists of SEQ ID NO: 2055.

In some instances, the endosomolytic moiety is melittin or its derivatives thereof. In some cases, the endosomolytic moiety comprises a polypeptide having at least 50%, 55%, 60%, 65%, 70%, 75%, 80%, 85%, 90%, 95%, 96%, 97%, 98%, 99%, or 100% sequence identity to SEQ ID NOs: 2060. In some cases, the endosomolytic moiety comprises SEQ ID NO: 2060. In some cases, the endosomolytic moiety consists of SEQ ID NO: 2060.

In some instances, the endosomolytic moiety is a sequence as illustrated in Table 62.

In additional cases, the endosomolytic moiety is an endosomolytic polymer, such as for example, a pH-responsive endosomolytic polymer, a membrane-disruptive polymer, a polycation polymer, a polyanion polymer, a pH-responsive membrane-disruptive polymer, or a combination thereof. In additional cases, the endosomolytic moiety comprises a p(alkylacrylic acid) polymer, a p(butyl acrylate-co-methacrylic acid) polymer, a p(styrene-alt-maleic anhydride) polymer, a pyridyldisulfide acrylate (PDSA) polymer, a polymer-PEG conjugate, a polymer-detergent conjugate, or a combination thereof.

In some embodiments, the endosomolytic moiety conjugate is according to Formula (IIa):

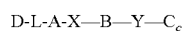    Formula IIa wherein,
A is a binding moiety;
B is a polynucleotide;
C is a polymer;
X is a bond or first linker;
Y is a bond or second linker;
L is a bond or third linker;
D is an endosomolytic moiety; and
c is an integer of 1; and wherein the polynucleotide comprises at least one 2' modified nucleotide, at least one modified internucleotide linkage, or at least one inverted abasic moiety.

In some embodiments, A and C are not attached to B at the same terminus.

In some embodiments, the at least one 2' modified nucleotide comprises 2'-O-methyl, 2'-O-methoxyethyl (2'-O-MOE), 2'-O-aminopropyl, 2'-deoxy, T-deoxy-2'-fluoro, 2'-O-aminopropyl (2'-O-AP), 2'-O-dimethylaminoethyl (2'-O-DMAOE), 2'-O-dimethylaminopropyl (2'-O-DMAP), T-O-dimethylaminoethyloxyethyl (2'-O-DMAEOE), or 2'-O—N-methylacetamido (2'-O-NMA) modified nucleotide. In some instances, the at least one 2' modified nucleotide comprises locked nucleic acid (LNA) or ethylene nucleic acid (ENA). In some cases, the at least one modified internucleotide linkage comprises a phosphorothioate linkage or a phosphorodithioate linkage. In some embodiments, the polynucleotide comprises a first polynucleotide and a second polynucleotide hybridized to the first polynucleotide to form a double-stranded polynucleic acid molecule. In some instances, the second polynucleotide comprises at least one modification. In some cases, the first polynucleotide and the second polynucleotide are RNA molecules. In some cases, the first polynucleotide and the second polynucleotide are siRNA molecules. In some embodiments, X, Y, and L are independently a bond or a non-polymeric linker group. In some instances, A is an antibody or binding fragment thereof. In some instances, the antibody or binding fragment thereof comprises a humanized antibody or binding fragment thereof, chimeric antibody or binding fragment thereof, monoclonal antibody or binding fragment thereof, monovalent Fab', divalent Fab2, single-chain variable fragment (scFv), diabody, minibody, nanobody, single-domain antibody (sdAb), or camelid antibody or binding fragment thereof. In some cases, C is polyethylene glycol.

In some instances, the endosomolytic moiety comprises a polypeptide, a polymer, a lipid, or a small molecule. In some instances, the endosomolytic moiety is an endosomolyticpolypeptide. In some cases, the endosomolytic moiety is an endosomolytic polymer. In other cases, the endosomolytic moiety is an endosomolytic lipid. In additional cases, the endosomolytic moiety is an endosomolytic small molecule.

In some instances, the endosomolytic moiety is INF7 or its derivatives thereof. In some cases, the endosomolytic moiety comprises a polypeptide having at least 50%, 55%, 60%, 65%, 70%, 75%, 80%, 85%, 90%, 95%, 96%, 97%, 98%, 99%, or 100% sequence identity to SEQ ID NOs: 2055. In some cases, the endosomolytic moiety comprises SEQ ID NO: 2055. In some cases, the endosomolytic moiety consists of SEQ ID NO: 2055.

In some instances, the endosomolytic moiety is melittin or its derivatives thereof. In some cases, the endosomolytic moiety comprises a polypeptide having at least 50%, 55%, 60%, 65%, 70%, 75%, 80%, 85%, 90%, 95%, 96%, 97%, 98%, 99%, or 100% sequence identity to SEQ ID NOs: 2060. In some cases, the endosomolytic moiety comprises SEQ ID NO: 2060. In some cases, the endosomolytic moiety consists of SEQ ID NO: 2060.

In some instances, the endosomolytic moiety is a sequence as illustrated in Table 62.

In additional cases, the endosomolytic moiety is an endosomolytic polymer, such as for example, a pH-responsive endosomolytic polymer, a membrane-disruptive polymer, a polycation polymer, a polyanion polymer, a pH-responsive membrane-disruptive polymer, or a combination thereof. In additional cases, the endosomolytic moiety comprises a p(alkylacrylic acid) polymer, a p(butyl acrylate-co-methacrylic acid) polymer, a p(styrene-alt-maleic anhydride) polymer, a pyridyldisulfide acrylate (PDSA) polymer, a polymer-PEG conjugate, a polymer-detergent conjugate, or a combination thereof.

In some instances, the endosomolytic moiety conjugate is according to Formula (IIb):

A-X—B-L-D    Formula IIb wherein,
A is a binding moiety;
B is a polynucleotide;
X is a bond or first linker;
L is a bond or third linker; and
D is an endosomolytic moiety; and
wherein the polynucleotide comprises at least one 2' modified nucleotide, at least one modified internucleotide linkage, or at least one inverted abasic moiety.

In some embodiments, A and C are not attached to B at the same terminus.

In some embodiments, the at least one 2' modified nucleotide comprises 2'-O-methyl, 2'-O-methoxyethyl (2'-O-MOE), 2'-O-aminopropyl, 2'-deoxy, T-deoxy-2'-fluoro, 2'-O-aminopropyl (2'-O-AP), 2'-O-dimethylaminoethyl (2'-O-DMAOE), 2'-O-dimethylaminopropyl (2'-O-DMAP), T-O-dimethylaminoethyloxyethyl (2'-O-DMAEOE), or 2'-O—N-methylacetamido (2'-O-NMA) modified nucleotide. In some instances, the at least one 2' modified nucleotide comprises locked nucleic acid (LNA) or ethylene nucleic acid (ENA). In some cases, the at least one modified internucleotide linkage comprises a phosphorothioate linkage or a phosphorodithioate linkage. In some embodiments, the polynucleotide comprises a first polynucleotide and a second polynucleotide hybridized to the first polynucleotide to form a double-stranded polynucleic acid molecule. In some instances, the second polynucleotide comprises at least one modification. In some cases, the first polynucleotide and the second polynucleotide are RNA molecules. In some cases, the first polynucleotide and the second polynucleotide are siRNA molecules. In some embodiments, X and L are independently a bond or a non-polymeric linker group. In some instances, A is an antibody or binding fragment thereof. In some instances, the antibody or binding fragment thereof comprises a humanized antibody or binding fragment thereof, chimeric antibody or binding fragment thereof, monoclonal antibody or binding fragment thereof, monovalent Fab', divalent Fab2, single-chain variable fragment (scFv), diabody, minibody, nanobody, single-domain antibody (sdAb), or camelid antibody or binding fragment thereof. In some cases, C is polyethylene glycol.

In some instances, the endosomolytic moiety comprises a polypeptide, a polymer, a lipid, or a small molecule. In some instances, the endosomolytic moiety is an endosomolytic polypeptide. In some cases, the endosomolytic moiety is an endosomolytic polymer. In other cases, the endosomolytic moiety is an endosomolytic lipid. In additional cases, the endosomolytic moiety is an endosomolytic small molecule.

In some instances, the endosomolytic moiety is INF7 or its derivatives thereof. In some cases, the endosomolytic moiety comprises a polypeptide having at least 50%, 55%, 60%, 65%, 70%, 75%, 80%, 85%, 90%, 95%, 96%, 97%, 98%, 99%, or 100% sequence identity to SEQ ID NOs: 2055. In some cases, the endosomolytic moiety comprises SEQ ID NO: 2055. In some cases, the endosomolytic moiety consists of SEQ ID NO: 2055.

In some instances, the endosomolytic moiety is melittin or its derivatives thereof. In some cases, the endosomolytic moiety comprises a polypeptide having at least 50%, 55%, 60%, 65%, 70%, 75%, 80%, 85%, 90%, 95%, 96%, 97%, 98%, 99%, or 100% sequence identity to SEQ ID NOs: 2060. In some cases, the endosomolytic moiety comprises SEQ ID NO: 2060. In some cases, the endosomolytic moiety consists of SEQ ID NO: 2060.

In some instances, the endosomolytic moiety is a sequence as illustrated in Table 62.

In additional cases, the endosomolytic moiety is an endosomolytic polymer, such as for example, a pH-responsive endosomolytic polymer, a membrane-disruptive polymer, a polycation polymer, a polyanion polymer, a pH-responsive membrane-disruptive polymer, or a combination thereof. In additional cases, the endosomolytic moiety comprises a p(alkylacrylic acid) polymer, a p(butyl acrylate-co-methacrylic acid) polymer, a p(styrene-alt-maleic anhydride) polymer, a pyridyldisulfide acrylate (PDSA) polymer, a polymer-PEG conjugate, a polymer-detergent conjugate, or a combination thereof.

In some instances, the endosomolytic moiety conjugate is according to Formula (IIc):

A-X—B—Y—$C_c$-L-D    Formula IIc wherein,
A is a binding moiety;
B is a polynucleotide;
C is a polymer;
X is a bond or first linker;
Y is a bond or second linker;
L is a bond or third linker;
D is an endosomolytic moiety; and
c is an integer of 1; and wherein the polynucleotide comprises at least one 2' modified nucleotide, at least one modified internucleotide linkage, or at least one inverted abasic moiety.

In some embodiments, A and C are not attached to B at the same terminus.

In some embodiments, the at least one 2' modified nucleotide comprises 2'-O-methyl, 2'-O-methoxyethyl (2'-O-MOE), 2'-O-aminopropyl, 2'-deoxy, T-deoxy-2'-fluoro, 2'-O-aminopropyl (2'-O-AP), 2'-O-dimethylaminoethyl (2'-O-DMAOE), 2'-O-dimethylaminopropyl (2'-O-DMAP), T-O-dimethylaminoethyloxyethyl (2'-O-DMAEOE), or 2'-O—N-methylacetamido (2'-O-NMA) modified nucleotide. In some instances, the at least one 2' modified nucleotide comprises locked nucleic acid (LNA) or ethylene nucleic acid (ENA). In some cases, the at least one modified internucleotide linkage comprises a phosphorothioate linkage or a phosphorodithioate linkage. In some embodiments, the polynucleotide comprises a first polynucleotide and a second polynucleotide hybridized to the first polynucleotide to form a double-stranded polynucleic acid molecule. In some instances, the second polynucleotide comprises at least one modification. In some cases, the first polynucleotide and the second polynucleotide are RNA molecules. In some cases, the first polynucleotide and the second polynucleotide are siRNA molecules. In some embodiments, X, Y, and L are independently a bond or a non-polymeric linker group. In some instances, A is an antibody or binding fragment thereof. In some instances, the antibody or binding fragment thereof comprises a humanized antibody or binding fragment thereof, chimeric antibody or binding fragment thereof, monoclonal antibody or binding fragment thereof, monovalent Fab', divalent Fab2, single-chain variable fragment (scFv), diabody, minibody, nanobody, single-domain antibody (sdAb), or camelid antibody or binding fragment thereof. In some cases, C is polyethylene glycol.

In some instances, the endosomolytic moiety comprises a polypeptide, a polymer, a lipid, or a small molecule. In some instances, the endosomolytic moiety is an endosomolytic polypeptide. In some cases, the endosomolytic moiety is an endosomolytic polymer. In other cases, the endosomolytic moiety is an endosomolytic lipid. In additional cases, the endosomolytic moiety is an endosomolytic small molecule.

In some instances, the endosomolytic moiety is INF7 or its derivatives thereof. In some cases, the endosomolytic moiety comprises a polypeptide having at least 50%, 55%, 60%, 65%, 70%, 75%, 80%, 85%, 90%, 95%, 96%, 97%, 98%, 99%, or 100% sequence identity to SEQ ID NOs: 2055. In some cases, the endosomolytic moiety comprises SEQ ID NO: 2055. In some cases, the endosomolytic moiety consists of SEQ ID NO: 2055.

In some instances, the endosomolytic moiety is melittin or its derivatives thereof. In some cases, the endosomolytic moiety comprises a polypeptide having at least 50%, 55%, 60%, 65%, 70%, 75%, 80%, 85%, 90%, 95%, 96%, 97%, 98%, 99%, or 100% sequence identity to SEQ ID NOs: 2060. In some cases, the endosomolytic moiety comprises SEQ ID NO: 2060. In some cases, the endosomolytic moiety consists of SEQ ID NO: 2060.

In some instances, the endosomolytic moiety is a sequence as illustrated in Table 62.

In additional cases, the endosomolytic moiety is an endosomolytic polymer, such as for example, a pH-responsive endosomolytic polymer, a membrane-disruptive polymer, a polycation polymer, a polyanion polymer, a pH-responsive membrane-disruptive polymer, or a combination thereof. In additional cases, the endosomolytic moiety comprises a p(alkylacrylic acid) polymer, a p(butyl acrylate-co-methacrylic acid) polymer, a p(styrene-alt-maleic anhydride) polymer, a pyridyldisulfide acrylate (PDSA) polymer, a polymer-PEG conjugate, a polymer-detergent conjugate, or a combination thereof.

In some instances, the endosomolytic moiety conjugate is according to Formula (IId):

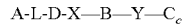  Formula IId wherein,
A is a binding moiety;
B is a polynucleotide;
C is a polymer;
X is a bond or first linker;
Y is a bond or second linker;
L is a bond or third linker;
D is an endosomolytic moiety; and
c is an integer of 1; and
wherein the polynucleotide comprises at least one 2' modified nucleotide, at least one modified internucleotide linkage, or at least one inverted abasic moiety.

In some embodiments, A and C are not attached to B at the same terminus.

In some embodiments, the at least one 2' modified nucleotide comprises 2'-O-methyl, 2'-O-methoxyethyl (2'-O-MOE), 2'-O-aminopropyl, 2'-deoxy, T-deoxy-2'-fluoro, 2'-O-aminopropyl (2'-O-AP), 2'-O-dimethylaminoethyl (2'-O-DMAOE), 2'-O-dimethylaminopropyl (2'-O-DMAP), T-O-dimethylaminoethyloxyethyl (2'-O-DMAEOE), or 2'-O—N-methylacetamido (2'-O-NMA) modified nucleotide. In some instances, the at least one 2' modified nucleotide comprises locked nucleic acid (LNA) or ethylene nucleic acid (ENA). In some cases, the at least one modified internucleotide linkage comprises a phosphorothioate linkage or a phosphorodithioate linkage. In some embodiments, the polynucleotide comprises a first polynucleotide and a second polynucleotide hybridized to the first polynucleotide to form a double-stranded polynucleic acid molecule. In some instances, the second polynucleotide comprises at least one modification. In some cases, the first polynucleotide and the second polynucleotide are RNA molecules. In some cases, the first polynucleotide and the second polynucleotide are siRNA molecules. In some embodiments, X, Y, and L are independently a bond or a non-polymeric linker group. In some instances, A is an antibody or binding fragment thereof. In some instances, the antibody or binding fragment thereof comprises a humanized antibody or binding fragment thereof, chimeric antibody or binding fragment thereof, monoclonal antibody or binding fragment thereof, monovalent Fab', divalent Fab2, single-chain variable fragment (scFv), diabody, minibody, nanobody, single-domain antibody (sdAb), or camelid antibody or binding fragment thereof. In some cases, C is polyethylene glycol.

In some instances, the endosomolytic moiety comprises a polypeptide, a polymer, a lipid, or a small molecule. In some instances, the endosomolytic moiety is an endosomolyticpolypeptide. In some cases, the endosomolytic moiety is an endosomolytic polymer. In other cases, the endosomolytic moiety is an endosomolytic lipid. In additional cases, the endosomolytic moiety is an endosomolytic small molecule.

In some instances, the endosomolytic moiety is INF7 or its derivatives thereof. In some cases, the endosomolytic moiety comprises a polypeptide having at least 50%, 55%, 60%, 65%, 70%, 75%, 80%, 85%, 90%, 95%, 96%, 97%, 98%, 99%, or 100% sequence identity to SEQ ID NOs: 2055. In some cases, the endosomolytic moiety comprises SEQ ID NO: 2055. In some cases, the endosomolytic moiety consists of SEQ ID NO: 2055.

In some instances, the endosomolytic moiety is melittin or its derivatives thereof. In some cases, the endosomolytic moiety comprises a polypeptide having at least 50%, 55%, 60%, 65%, 70%, 75%, 80%, 85%, 90%, 95%, 96%, 97%, 98%, 99%, or 100% sequence identity to SEQ ID NOs: 2060. In some cases, the endosomolytic moiety comprises SEQ ID NO: 2060. In some cases, the endosomolytic moiety consists of SEQ ID NO: 2060.

In some instances, the endosomolytic moiety is a sequence as illustrated in Table 62.

In additional cases, the endosomolytic moiety is an endosomolytic polymer, such as for example, a pH-responsive endosomolytic polymer, a membrane-disruptive polymer, a polycation polymer, a polyanion polymer, a pH-responsive membrane-disruptive polymer, or a combination thereof. In additional cases, the endosomolytic moiety comprises a p(alkylacrylic acid) polymer, a p(butyl acrylate-co-methacrylic acid) polymer, a p(styrene-alt-maleic anhydride) polymer, a pyridyldisulfide acrylate (PDSA) polymer, a polymer-PEG conjugate, a polymer-detergent conjugate, or a combination thereof.

Linkers

In some embodiments, a linker described herein is a cleavable linker or a non-cleavable linker. In some instances, the linker is a cleavable linker. In some instances, the linker is an acid cleavable linker. In some instances, the linker is a non-cleavable linker. In some instances, the linker includes a $C_1$-$C_6$ alkyl group (e.g., a $C_5$, $C_4$, $C_3$, $C_2$, or $C_1$ alkyl group). In some instances, the linker includes homobifunctional cross linkers, heterobifunctional cross linkers, and the like. In some instances, the liker is a traceless linker (or a zero-length linker). In some instances, the linker is a non-polymeric linker. In some cases, the linker is a non-peptide linker or a linker that does not contain an amino acid residue.

In some instances, the linker comprises a homobifuctional linker. Exemplary homobifuctional linkers include, but are not limited to, Lomant's reagent dithiobis (succinimidylpropionate) DSP, 3'3'-dithiobis(sulfosuccinimidyl proprinate (DTSSP), disuccinimidyl suberate (DSS), bis(sulfosuccinimidyl)suberate (BS), disuccinimidyl tartrate (DST), disulfosuccinimidyl tartrate (sulfo DST), ethylene glycobis(succinimidylsuccinate) (EGS), disuccinimidyl glutarate (DSG), N,N'-disuccinimidyl carbonate (DSC), dimethyl adipimidate (DMA), dimethyl pimelimidate (DMP), dimethyl suberimidate (DMS), dimethyl-3,3'-dithiobispropionimidate (DTBP), 1,4-di-3'-(2'-pyridyldithio)propionamido)butane (DPDPB), bismaleimidohexane (BMH), aryl halide-containing compound (DFDNB), such as e.g. 1,5-difluoro-2,4-dinitrobenzene or 1,3-difluoro-4,6-dinitrobenzene, 4,4'-difluoro-3,3'-dinitrophenylsulfone (DFDNPS), bis-[β-(4-azidosalicylamido)ethyl]disulfide (BASED), formaldehyde, glutaraldehyde, 1,4-butanediol diglycidyl ether, adipic acid dihydrazide, carbohydrazide, o-toluidine, 3,3'-dimethylbenzidine, benzidine, α,α'-p-diaminodiphenyl, diiodo-p-xylene sulfonic acid, N,N'-ethylene-bis(iodoacetamide), or N,N'-hexamethylene-bis(iodoacetamide).

In some embodiments, the linker comprises a heterobifunctional linker. Exemplary heterobifunctional linker include, but are not limited to, amine-reactive and sulfhydryl cross-linkers such as N-succinimidyl 3-(2-pyridyldithio) propionate (sPDP), long-chain N-succinimidyl 3-(2-pyridyldithio)propionate (LC-sPDP), water-soluble-long-chain N-succinimidyl 3-(2-pyridyldithio) propionate (sulfo-LC-sPDP), succinimidyloxycarbonyl-α-methyl-α-(2-pyridyldithio)toluene (sMPT), sulfosuccinimidyl-6[α-methyl-α-(2-pyridyldithio)toluamido]hexanoate (sulfo-LC-sMPT), succinimidyl-4-(N-maleimidomethyl)cyclohexane-1-carboxylate (sMCC), sulfosuccinimidyl-4-(N-maleimidomethyl)cyclohexane-1-carboxylate (sulfo-sMCC), m-maleimidobenzoyl-N-hydroxysuccinimi de ester (MBs), m-maleimidobenzoyl-N-hydroxysulfosuccinimide ester (sulfo-MBs), N-succinimidyl(4-iodoacteyl)aminobenzoate (sIAB), sulfosuccinimidyl(4-iodoacteyl)aminobenzoate (sulfo-sIAB), succinimidyl-4-(p-maleimidophenyl)butyrate (sMPB), sulfosuccinimidyl-4-(p-maleimidophenyl)butyrate (sulfo-sMPB), N-(γ-maleimidobutyryloxy)succinimide ester (GMBs), N-(γ-maleimidobutyryloxy)sulfosuccinimide ester (sulfo-GMBs), succinimidyl 6-((iodoacetyl)amino)hexanoate (sIAX), succinimidyl6-[6-(((iodoacetyl)amino) hexanoyl]amino]hexanoate (sIAXX), succinimidyl 4-(((iodoacetyl)amino)methyl)cyclohexane-1-carboxylate (sIAC), succinimidyl 6-((((4-iodoacetyl)amino)methyl)cyclohexane-1-carbonyl)amino) hexanoate (sIACX), p-nitrophenyl iodoacetate (NPIA), carbonyl-reactive and sulfhydryl-reactive cross-linkers such as 4-(4-N-maleimidophenyl) butyric acid hydrazide (MPBH), 4-(N-maleimidomethyl) cyclohexane-1-carboxyl-hydrazide-8 ($M_2C_2H$), 3-(2-pyridyldithio)propionyl hydrazide (PDPH), amine-reactive and photoreactive cross-linkers such as N-hydroxysuccinimidyl-4-azidosalicylic acid (NHs-AsA), N-hydroxysulfosuccinimidyl-4-azidosalicylic acid (sulfo-NHs-AsA), sulfosuccinimidyl-(4-azidosalicylamido)hexanoate (sulfo-NHs-LC-AsA), sulfosuccinimidyl-2-(ρ-azidosalicylamido)ethyl-1,3'-dithiopropionate (sAsD), N-hydroxysuccinimidyl-4-azidobenzoate (HsAB), N-hydroxysulfosuccinimidyl-4-azidobenzoate (sulfo-HsAB), N-succinimidyl-6-(4'-azido-2'-nitrophenylamino)hexanoate (sANPAH), sulfosuccinimidyl-6-(4'-azido-2'-nitrophenylamino)hexanoate (sulfo-sANPAH), N-5-azido-2-nitrobenzoyloxysuccinimide (ANB-NOs), sulfosuccinimidyl-2-(m-azido-o-nitrobenzamido)-ethyl-1,3'-dithiopropionate (sAND), N-succinimidyl-4(4-azidophenyl)1,3'-dithiopropionate (sADP), N-sulfosuccinimidyl(4-azidophenyl)-1,3'-dithiopropionate (sulfo-sADP), sulfosuccinimidyl 4-(ρ-azidophenyl)butyrate (sulfo-sAPB), sulfosuccinimidyl 2-(7-azido-4-methylcoumarin-3-acetamide)ethyl-1,3'-dithiopropionate (sAED), sulfosuccinimidyl 7-azido-4-methylcoumain-3-acetate (sulfo-sAMCA), ρ-nitrophenyl diazopyruvate (ρNPDP), ρ-nitrophenyl-2-diazo-3,3,3-trifluoropropionate (PNP-DTP), sulfhydryl-reactive and photoreactive cross-linkers such as 1-(ρ-Azidosalicylamido)-4-(iodoacetamido) butane (AsIB), N-[4-(ρ-azidosalicylamido)butyl]-3'-(2'-pyridyldithio)propionamide (APDP), benzophenone-4-iodoacetamide, benzophenone-4-maleimide carbonyl-reactive and photoreactive cross-linkers such as ρ-azidobenzoyl hydrazide (ABH), carboxylate-reactive and photoreactive cross-linkers such as 4-(ρ-azidosalicylamido) butylamine (AsBA), and arginine-reactive and photoreactive cross-linkers such as ρ-azidophenyl glyoxal (APG).

In some instances, the linker comprises a reactive functional group. In some cases, the reactive functional group comprises a nucleophilic group that is reactive to an electrophilic group present on a binding moiety. Exemplary electrophilic groups include carbonyl groups—such as aldehyde, ketone, carboxylic acid, ester, amide, enone, acyl halide or acid anhydride. In some embodiments, the reactive functional group is aldehyde. Exemplary nucleophilic groups include hydrazide, oxime, amino, hydrazine, thiosemicarbazone, hydrazine carboxylate, and arylhydrazide.

In some embodiments, the linker comprises a maleimide group. In some instances, the maleimide group is also referred to as a maleimide spacer. In some instances, the maleimide group further encompasses a caproic acid, forming maleimidocaproyl (mc). In some cases, the linker comprises maleimidocaproyl (mc). In some cases, the linker is maleimidocaproyl (mc). In other instances, the maleimide group comprises a maleimidomethyl group, such as succinimidyl-4-(N-maleimidomethyl)cyclohexane-1-carboxylate (sMCC) or sulfosuccinimidyl-4-(N-maleimidomethyl)cyclohexane-1-carboxylate (sulfo-sMCC) described above.

In some embodiments, the maleimide group is a self-stabilizing maleimide. In some instances, the self-stabilizing maleimide utilizes diaminopropionic acid (DPR) to incorporate a basic amino group adjacent to the maleimide to provide intramolecular catalysis of tiosuccinimide ring hydrolysis, thereby eliminating maleimide from undergoing an elimination reaction through a retro-Michael reaction. In some instances, the self-stabilizing maleimide is a maleimide group described in Lyon, et al., "Self-hydrolyzing maleimides improve the stability and pharmacological properties of antibody-drug conjugates," *Nat. Biotechnol.* 32(10):1059-1062 (2014). In some instances, the linker comprises a self-stabilizing maleimide. In some instances, the linker is a self-stabilizing maleimide.

In some embodiments, the linker comprises a peptide moiety. In some instances, the peptide moiety comprises at least 2, 3, 4, 5, 6, 7, 8, or more amino acid residues. In some instances, the peptide moiety is a cleavable peptide moiety (e.g., either enzymatically or chemically). In some instances, the peptide moiety is a non-cleavable peptide moiety. In some instances, the peptide moiety comprises Val-Cit (valine-citrulline), Gly-Gly-Phe-Gly (SEQ ID NO: 2111), Phe-Lys, Val-Lys, Gly-Phe-Lys, Phe-Phe-Lys, Ala-Lys, Val-Arg, Phe-Cit, Phe-Arg, Leu-Cit, Ile-Cit, Trp-Cit, Phe-Ala, Ala-Leu-Ala-Leu (SEQ ID NO: 2112), or Gly-Phe-Leu-Gly (SEQ ID NO: 2113). In some instances, the linker comprises a peptide moiety such as: Val-Cit (valine-citrulline), Gly-Gly-Phe-Gly (SEQ ID NO: 2111), Phe-Lys, Val-Lys, Gly-Phe-Lys, Phe-Phe-Lys, Ala-Lys, Val-Arg, Phe-Cit, Phe-Arg, Leu-Cit, Ile-Cit, Trp-Cit, Phe-Ala, Ala-Leu-Ala-Leu (SEQ ID NO: 2112), or Gly-Phe-Leu-Gly (SEQ ID NO: 2113). In some cases, the linker comprises Val-Cit. In some cases, the linker is Val-Cit.

In some embodiments, the linker comprises a benzoic acid group, or its derivatives thereof. In some instances, the benzoic acid group or its derivatives thereof comprise paraaminobenzoic acid (PABA). In some instances, the benzoic acid group or its derivatives thereof comprise gamma-aminobutyric acid (GABA).

In some embodiments, the linker comprises one or more of a maleimide group, a peptide moiety, and/or a benzoic acid group, in any combination. In some embodiments, the linker comprises a combination of a maleimide group, a peptide moiety, and/or a benzoic acid group. In some instances, the maleimide group is maleimidocaproyl (mc). In some instances, the peptide group is val-cit. In some instances, the benzoic acid group is PABA. In some instances, the linker comprises a mc-val-cit group. In some cases, the linker comprises a val-cit-PABA group. In additional cases, the linker comprises a mc-val-cit-PABA group.

In some embodiments, the linker is a self-immolative linker or a self-elimination linker. In some cases, the linker is a self-immolative linker. In other cases, the linker is a self-elimination linker (e.g., a cyclization self-elimination linker). In some instances, the linker comprises a linker described in U.S. Pat. No. 9,089,614 or PCT Publication No. WO2015038426.

In some instances, the linker is a dendritic type linker. In some instances, the dendritic type linker comprises a branching, multifunctional linker moiety. In some instances, the dendritic type linker is used to increase the molar ratio of polynucleotide B to the binding moiety A. In some instances, the dendritic type linker comprises PAMAM dendrimers.

In some embodiments, the linker is a traceless linker or a linker in which after cleavage does not leave behind a linker moiety (e.g., an atom or a linker group) to a binding moiety A, a polynucleotide B, a polymer C, or an endosomolytic moiety D. Exemplary traceless linkers include, but are not limited to, germanium linkers, silicium linkers, sulfur linkers, selenium linkers, nitrogen linkers, phosphorus linkers, boron linkers, chromium linkers, or phenylhydrazide linker. In some cases, the linker is a traceless aryl-triazene linker as described in Hejesen, et al., "A traceless aryl-triazene linker for DNA-directed chemistry," *Org Biomol Chem* 11(15): 2493-2497 (2013). In some instances, the linker is a traceless linker described in Blaney, et al., "Traceless solid-phase organic synthesis," *Chem. Rev.* 102: 2607-2024 (2002). In some instances, a linker is a traceless linker as described in U.S. Pat. No. 6,821,783.

In some instances, the linker comprises a functional group that exerts steric hinderance at the site of bonding between the linker and a conjugating moiety (e.g., A, B, C, or D described herein). In some instances, the steric hinderance is a steric hinderance around a disulfide bond. Exemplary linkers that exhibit steric hinderance comprises a heterobifuctional linker, such as a heterobifunctional linker described above. In some cases, a linker that exhibits steric hinderance comprises SMCC and SPDB.

In some instances, the linker is an acid cleavable linker. In some instances, the acid cleavable linker comprises a hydrazone linkage, which is susceptible to hydrolytic cleavage. In some cases, the acid cleavable linker comprises a thiomaleamic acid linker. In some cases, the acid cleavable linker is a thiomaleamic acid linker as described in Castaneda, et al, "Acid-cleavable thiomaleamic acid linker for homogeneous antibody-drug conjugation," *Chem. Commun.* 49: 8187-8189 (2013).

In some instances, the linker is a linker described in U.S. Pat. No. 6,884,869; 7,498,298; 8,288,352; 8,609,105; or 8,697,688; U.S. Patent Publication Nos. 2014/0127239; 2013/028919; 2014/286970; 2013/0309256; 2015/037360; or 2014/0294851; or PCT Publication Nos. WO2015057699; WO2014080251; WO2014197854; WO2014145090; or WO2014177042.

In some embodiments, X, Y, and L are independently a bond or a linker. In some instances, X, Y, and L are independently a bond. In some cases, X, Y, and L are independently a linker.

In some instances, X is a bond or a linker. In some instances, X is a bond. In some instances, X is a linker. In some instances, the linker is a $C_1$-$C_6$ alkyl group. In some cases, X is a $C_1$-$C_6$ alkyl group, such as for example, a $C_5$, $C_4$, $C_3$, $C_2$, or $C_1$ alkyl group. In some cases, the $C_1$-$C_6$ alkyl group is an unsubstituted $C_1$-$C_6$ alkyl group. As used in the context of a linker, and in particular in the context of X, alkyl means a saturated straight or branched hydrocarbon radical containing up to six carbon atoms. In some instances, X is a non-polymeric linker. In some instances, X includes a homobifunctional linker or a heterobifunctional linker described supra. In some cases, X includes a heterobifunctional linker. In some cases, X includes sMCC. In other instances, X includes a heterobifunctional linker optionally conjugated to a $C_1$-$C_6$ alkyl group. In other instances, X includes sMCC optionally conjugated to a $C_1$-$C_6$ alkyl group. In additional instances, X does not include a homobifunctional linker or a heterobifunctional linker described supra.

In some instances, Y is a bond or a linker. In some instances, Y is a bond. In other cases, Y is a linker. In some embodiments, Y is a $C_1$-$C_6$ alkyl group. In some instances, Y is a homobifuctional linker or a heterobifunctional linker described supra. In some instances, Y is a homobifunctional linker described supra. In some instances, Y is a heterobifunctional linker described supra. In some instances, Y comprises a maleimide group, such as maleimidocaproyl (mc) or a self-stabilizing maleimide group described above. In some instances, Y comprises a peptide moiety, such as Val-Cit. In some instances, Y comprises a benzoic acid group, such as PABA. In additional instances, Y comprises a combination of a maleimide group, a peptide moiety, and/or a benzoic acid group. In additional instances, Y comprises a mc group. In additional instances, Y comprises a mc-val-cit group. In additional instances, Y comprises a val-cit-PABA group. In additional instances, Y comprises a mc-val-cit-PABA group.

In some instances, L is a bond or a linker. In some cases, L is a bond. In other cases, L is a linker. In some embodiments, L is a $C_1$-$C_6$ alkyl group. In some instances, L is a homobifunctional linker or a heterobifunctional linker described supra. In some instances, L is a homobifunctional linker described supra. In some instances, L is a heterobifunctional linker described supra. In some instances, L comprises a maleimide group, such as maleimidocaproyl (mc) or a self-stabilizing maleimide group described above. In some instances, L comprises a peptide moiety, such as Val-Cit. In some instances, L comprises a benzoic acid group, such as PABA. In additional instances, L comprises a combination of a maleimide group, a peptide moiety, and/or a benzoic acid group. In additional instances, L comprises a mc group. In additional instances, L comprises a mc-val-cit group. In additional instances, L comprises a val-cit-PABA group. In additional instances, L comprises a mc-val-cit-PABA group.

Methods of Use

In some embodiments, a composition or a pharmaceutical formulation described herein comprising a binding moiety conjugated to a polynucleic acid molecule and a polymer is used for the treatment of a disease or disorder. In some instances, the disease or disorder is a cancer. In some embodiments, a composition or a pharmaceutical formulation described herein is used as an immunotherapy for the treatment of a disease or disorder. In some instances, the immunotherapy is an immuno-oncology therapy.

Cancer

In some embodiments, a composition or a pharmaceutical formulation described herein is used for the treatment of cancer. In some instances, the cancer is a solid tumor. In some instances, the cancer is a hematologic malignancy. In some instances, the cancer is a relapsed or refractory cancer, or a metastatic cancer. In some instances, the solid tumor is a relapsed or refractory solid tumor, or a metastatic solid tumor. In some cases, the hematologic malignancy is a relapsed or refractory hematologic malignancy, or a metastatic hematologic malignancy.

In some embodiments, the cancer is a solid tumor. Exemplary solid tumor includes, but is not limited to, anal cancer, appendix cancer, bile duct cancer (i.e., cholangiocarcinoma), bladder cancer, brain tumor, breast cancer, cervical cancer, colon cancer, cancer of Unknown Primary (CUP), esophageal cancer, eye cancer, fallopian tube cancer, gastroenterological cancer, kidney cancer, liver cancer, lung cancer, medulloblastoma, melanoma, oral cancer, ovarian cancer, pancreatic cancer, parathyroid disease, penile cancer, pituitary tumor, prostate cancer, rectal cancer, skin cancer, stomach cancer, testicular cancer, throat cancer, thyroid cancer, uterine cancer, vaginal cancer, or vulvar cancer.

In some instances, a composition or a pharmaceutical formulation described herein comprising a binding moiety conjugated to a polynucleic acid molecule and a polymer is used for the treatment of a solid tumor. In some instances, a composition or a pharmaceutical formulation described herein comprising a binding moiety conjugated to a polynucleic acid molecule and a polymer is used for the treatment of anal cancer, appendix cancer, bile duct cancer (i.e., cholangiocarcinoma), bladder cancer, brain tumor, breast cancer, cervical cancer, colon cancer, cancer of Unknown Primary (CUP), esophageal cancer, eye cancer, fallopian tube cancer, gastroenterological cancer, kidney cancer, liver cancer, lung cancer, medulloblastoma, melanoma, oral cancer, ovarian cancer, pancreatic cancer, parathyroid disease, penile cancer, pituitary tumor, prostate cancer, rectal cancer, skin cancer, stomach cancer, testicular cancer, throat cancer, thyroid cancer, uterine cancer, vaginal cancer, or vulvar cancer. In some instances, the solid tumor is a relapsed or refractory solid tumor, or a metastatic solid tumor.

In some instances, the cancer is a hematologic malignancy. In some instances, the hematologic malignancy is a leukemia, a lymphoma, a myeloma, a non-Hodgkin's lymphoma, or a Hodgkin's lymphoma. In some instances, the hematologic malignancy comprises chronic lymphocytic leukemia (CLL), small lymphocytic lymphoma (SLL), high risk CLL, a non-CLL/SLL lymphoma, prolymphocytic leukemia (PLL), follicular lymphoma (FL), diffuse large B-cell lymphoma (DLBCL), mantle cell lymphoma (MCL), Waldenström's macroglobulinemia, multiple myeloma, extranodal marginal zone B cell lymphoma, nodal marginal zone B cell lymphoma, Burkitt's lymphoma, non-Burkitt high grade B cell lymphoma, primary mediastinal B-cell lymphoma (PMBL), immunoblastic large cell lymphoma, precursor B-lymphoblastic lymphoma, B cell prolymphocytic leukemia, lymphoplasmacytic lymphoma, splenic marginal zone lymphoma, plasma cell myeloma, plasmacytoma, mediastinal (thymic) large B cell lymphoma, intravascular large B cell lymphoma, primary effusion lymphoma, or lymphomatoid granulomatosis.

In some instances, a composition or a pharmaceutical formulation described herein comprising a binding moiety conjugated to a polynucleic acid molecule and a polymer is used for the treatment of a hematologic malignancy. In some instances, a composition or a pharmaceutical formulation described herein comprising a binding moiety conjugated to a polynucleic acid molecule and a polymer is used for the treatment of a leukemia, a lymphoma, a myeloma, a non-Hodgkin's lymphoma, or a Hodgkin's lymphoma. In some instances, the hematologic malignancy comprises chronic lymphocytic leukemia (CLL), small lymphocytic lymphoma (SLL), high risk CLL, a non-CLL/SLL lymphoma, prolymphocytic leukemia (PLL), follicular lymphoma (FL), diffuse large B-cell lymphoma (DLBCL), mantle cell lymphoma (MCL), Waldenström's macroglobulinemia, multiple myeloma, extranodal marginal zone B cell lymphoma, nodal marginal zone B cell lymphoma, Burkitt's lymphoma, non-Burkitt high grade B cell lymphoma, primary mediastinal B-cell lymphoma (PMBL), immunoblastic large cell lymphoma, precursor B-lymphoblastic lymphoma, B cell prolymphocytic leukemia, lymphoplasmacytic lymphoma, splenic marginal zone lymphoma, plasma cell myeloma, plasmacytoma, mediastinal (thymic) large B cell lymphoma, intravascular large B cell lymphoma, primary effusion lymphoma, or lymphomatoid granulomatosis. In some cases, the hematologic malignancy is a relapsed or refractory hematologic malignancy, or a metastatic hematologic malignancy.

In some instances, the cancer is a KRAS-associated, EGFR-associated, AR-associated cancer, HPRT1-associated cancer, or β-catenin associated cancer. In some instances, a composition or a pharmaceutical formulation described herein comprising a binding moiety conjugated to a polynucleic acid molecule and a polymer is used for the treatment of a KRAS-associated, EGFR-associated, AR-associated cancer, HPRT1-associated cancer, or β-catenin associated cancer. In some instances, a composition or a pharmaceutical formulation described herein comprising a binding moiety conjugated to a polynucleic acid molecule and a polymer is used for the treatment of a KRAS-associated cancer. In some instances, a composition or a pharmaceutical formulation described herein comprising a binding moiety conjugated to a polynucleic acid molecule and a polymer is used for the treatment of an EGFR-associated cancer. In some instances, a composition or a pharmaceutical formulation described herein comprising a binding moiety conjugated to a polynucleic acid molecule and a polymer is used for the treatment of an AR-associated cancer. In some instances, a composition or a pharmaceutical formulation described herein comprising a binding moiety conjugated to a polynucleic acid molecule and a polymer is used for the treatment of an HPRT1-associated cancer. In some instances, a composition or a pharmaceutical formulation described herein comprising a binding moiety conjugated to a polynucleic acid molecule and a polymer is used for the treatment of a β-catenin associated cancer. In some instances, the cancer is a solid tumor. In some instances, the cancer is a hematologic malignancy. In some instances, the solid tumor is a relapsed or refractory solid tumor, or a metastatic solid tumor. In some cases, the hematologic malignancy is a relapsed or refractory hematologic malignancy, or a metastatic hematologic malignancy. In some instances, the cancer comprises bladder cancer, breast cancer, colorectal cancer, endometrial cancer, esophageal cancer, glioblastoma multiforme, head and neck cancer, kidney cancer, lung cancer, ovarian cancer, pancreatic cancer, prostate cancer, thyroid cancer, acute myeloid leukemia, CLL, DLBCL, or multiple myeloma. In some instances, the β-catenin associated cancer further comprises PIK3C-associated cancer and/or MYC-associated cancer.

Immunotherapy

In some embodiments, a composition or a pharmaceutical formulation described herein is used as an immunotherapy for the treatment of a disease or disorder. In some instances, the immunotherapy is an immuno-oncology therapy. In some instances, immuno-oncology therapy is categorized into active, passive, or combinatory (active and passive) methods. In active immuno-oncology therapy method, for example, tumor-associated antigens (TAAs) are presented to the immune system to trigger an attack on cancer cells presenting these TAAs. In some instances, the active immune-oncology therapy method includes tumor-targeting and/or immune-targeting agents (e.g., checkpoint inhibitor agents such as monoclonal antibodies), and/or vaccines, such as in situ vaccination and/or cell-based or non-cell based (e.g., dendritic cell-based, tumor cell-based, antigen, anti-idiotype, DNA, or vector-based) vaccines. In some instances, the cell-based vaccines are vaccines which are generated using activated immune cells obtained from a patient's own immune system which are then activated by the patient's own cancer. In some instances, the active immune-oncology therapy is further subdivided into non-specific active immunotherapy and specific active immunotherapy. In some instances, non-specific active immunotherapy utilizes cytokines and/or other cell signaling components to induce a general immune system response. In some cases, specific active immunotherapy utilizes specific TAAs to elicite an immune response.

In some embodiments, a composition or a pharmaceutical formulation described herein is used as an active immuno-oncology therapy method for the treatment of a disease or disorder (e.g., cancer). In some embodiments, the composition or a pharmaceutical formulation described herein comprises a tumor-targeting agent. In some instances, the tumor-targeting agent is encompassed by a binding moiety A. In other instances, the tumor-targeting agent is an additional agent used in combination with a molecule of Formula (I). In some instances, the tumor-targeting agent is a tumor-directed polypeptide (e.g., a tumor-directed antibody). In some instances, the tumor-targeting agent is a tumor-directed antibody, which exerts its antitumor activity through mechanisms such as direct killing (e.g., signaling-induced apoptosis), complement-dependent cytotoxicity (CDC), and/or antibody-dependent cell-mediated cytotoxicity (ADCC). In additional instances, the tumor-targeting agent elicits an adaptive immune response, with the induction of antitumor T cells.

In some embodiments, the binding moiety A is a tumor-directed polypeptide (e.g., a tumor-directed antibody). In some instances, the binding moiety A is a tumor-directed antibody, which exerts its antitumor activity through mechanisms such as direct killing (e.g., signaling-induced apoptosis), complement-dependent cytotoxicity (CDC), and/or antibody-dependent cell-mediated cytotoxicity (ADCC). In additional instances, the binding moiety A elicits an adaptive immune response, with the induction of antitumor T cells.

In some embodiments, the composition or a pharmaceutical formulation described herein comprises an immune-targeting agent. In some instances, the immune-targeting agent is encompassed by a binding moiety A. In other instances, the immune-targeting agent is an additional agent used in combination with a molecule of Formula (I). In some instances, the immune-targeting agent comprises cytokines, checkpoint inhibitors, or a combination thereof.

In some embodiments, the immune-targeting agent is a checkpoint inhibitor. In some cases, an immune checkpoint molecule is a molecule presented on the cell surface of CD4 and/or CD8 T cells. Exemplary immune checkpoint molecules include, but are not limited to, Programmed Death-Ligand 1 (PD-L1, also known as B7-H1, CD274), Programmed Death 1 (PD-1), CTLA-4, B7H1, B7H4, OX-40, CD137, CD40, 2B4, IDO1, IDO2, VISTA, CD27, CD28, PD-L2 (B7-DC, CD273), LAG3, CD80, CD86, PDL2, B7H3, HVEM, BTLA, KIR, GAL9, TIM3, A2aR, MARCO (macrophage receptor with collageneous structure), PS (phosphatidylserine), ICOS (inducible T cell costimulator), HAVCR2, CD276, VTCN1, CD70, and CD160.

In some instances, an immune checkpoint inhibitor refers to any molecule that modulates or inhibits the activity of an immune checkpoint molecule. In some instances, immune checkpoint inhibitors include antibodies, antibody-derivatives (e.g., Fab fragments, scFvs, minobodies, diabodies), antisense oligonucleotides, siRNA, aptamers, or peptides. In some embodiments, an immune checkpoint inhibitor is an inhibitor of Programmed Death-Ligand 1 (PD-L1, also known as B7-H1, CD274), Programmed Death 1 (PD-1), CTLA-4, PD-L2 (B7-DC, CD273), LAG3, TIM3, 2B4, A2aR, B71-11, B7H3, B7H4, BTLA, CD2, CD27, CD28, CD30, CD40, CD70, CD80, CD86, CD137, CD160, CD226, CD276, DR3, GAL9, GITR, HAVCR2, HVEM, IDO1, IDO2, ICOS (inducible T cell costimulator), KIR, LAIR1, LIGHT, MARCO (macrophage receptor with collagenous structure), PS (phosphatidylserine), OX-40, SLAM, TIGHT, VISTA, VTCN1, or any combinations thereof.

In some embodiments, exemplary checkpoint inhibitors include:

PD-L1 inhibitors such as Genentech's MPDL3280A (RG7446), Anti-mouse PD-L1 antibody Clone 10F.9G2 (Cat # BE0101) from BioXcell, anti-PD-L1 monoclonal antibody MDX-1105 (BMS-936559) and BMS-935559 from Bristol-Meyer's Squibb, MSB0010718C, mouse anti-PD-L1 Clone 29E.2A3, and AstraZeneca's MED14736;

PD-L2 inhibitors such as GlaxoSmithKline's AMP-224 (Amplimmune), and rHIgM12B7;

PD-1 inhibitors such as anti-mouse PD-1 antibody Clone J43 (Cat # BE0033-2) from BioXcell, anti-mouse PD-1 antibody Clone RMP1-14 (Cat # BE0146) from BioXcell, mouse anti-PD-1 antibody Clone EH12, Merck's MK-3475 anti-mouse PD-1 antibody (Keytruda, pembrolizumab, lambrolizumab), AnaptysBio's anti-PD-1 antibody known as ANB011, antibody MDX-1106 (ONO-4538), Bristol-Myers Squibb's human IgG4 monoclonal antibody nivolumab (Opdivo®, BMS-936558, MDX1106), AstraZeneca's AMP-514 and AMP-224, and Pidilizumab (CT-011) from CureTech Ltd; CTLA-4 inhibitors such as Bristol Meyers Squibb's anti-CTLA-4 antibody ipilimumab (also known as Yervoy®, MDX-010, BMS-734016 and MDX-101), anti-CTLA4 Antibody, clone 9H10 from Millipore, Pfizer's tremelimumab (CP-675,206, ticilimumab), and anti-CTLA4 antibody clone BNI3 from Abcam;

LAG3 inhibitors such as anti-Lag-3 antibody clone eBioC9B7W (C9B7W) from eBioscience, anti-Lag3 antibody LS-B2237 from LifeSpan Biosciences, IMP321 (ImmuFact) from Immutep, anti-Lag3 antibody BMS-986016, and the LAG-3 chimeric antibody A9H12;

B7-H3 inhibitors such as MGA271;

KIR inhibitors such as Lirilumab (IPH2101);

CD137 (41BB) inhibitors such as urelumab (BMS-663513, Bristol-Myers Squibb), PF-05082566 (anti-4-1BB, PF-2566, Pfizer), or XmAb-5592 (Xencor);

PS inhibitors such as Bavituximab;

and inhibitors such as an antibody or fragments (e.g., a monoclonal antibody, a human, humanized, or chimeric antibody) thereof, RNAi molecules, or small molecules to TIM3, CD52, CD30, CD20, CD33, CD27, OX40 (CD134), GITR, ICOS, BTLA (CD272), CD160, 2B4, LAIR1, TIGHT, LIGHT, DR3, CD226, CD2, or SLAM.

In some embodiments, a binding moiety A comprising an immune checkpoint inhibitor is used for the treatment of a disease or disorder (e.g., cancer). In some instances, the binding moiety A is a bispecific antibody or a binding fragment thereof that comprises an immune checkpoint inhibitor. In some cases, a binding moiety A comprising an inhibitor of Programmed Death-Ligand 1 (PD-L1, also known as B7-H1, CD274), Programmed Death 1 (PD-1), CTLA-4, PD-L2 (B7-DC, CD273), LAG3, TIM3, 2B4, A2aR, B7H1, B7H3, B7H4, BTLA, CD2, CD27, CD28, CD30, CD40, CD70, CD80, CD86, CD137, CD160, CD226, CD276, DR3, GAL9, GITR, HAVCR2, HVEM, IDO1, IDO2, ICOS (inducible T cell costimulator), KIR, LAIR1, LIGHT, MARCO (macrophage receptor with collagenous structure), PS (phosphatidylserine), OX-40, SLAM, TIGHT, VISTA, VTCN1, or any combinations thereof, is used for the treatment of a disease or disorder (e.g., cancer).

In some embodiments, a molecule of Formula (I) in combination with an immune checkpoint inhibitor is used for the treatment of a disease or disorder (e.g., cancer). In some instances, the immune checkpoint inhibitor comprises an inhibitor of Programmed Death-Ligand 1 (PD-L1, also known as B7-H1, CD274), Programmed Death 1 (PD-1), CTLA-4, PD-L2 (B7-DC, CD273), LAG3, TIM3, 2B4, A2aR, B7H1, B7H3, B7H4, BTLA, CD2, CD27, CD28, CD30, CD40, CD70, CD80, CD86, CD137, CD160, CD226, CD276, DR3, GAL9, GITR, HAVCR2, HVEM, IDO1, IDO2, ICOS (inducible T cell costimulator), KIR, LAIR1, LIGHT, MARCO (macrophage receptor with collagenous structure), PS (phosphatidylserine), OX-40, SLAM, TIGHT, VISTA, VTCN1, or any combinations thereof. In some cases, a molecule of Formula (I) is used in combination with ipilimumab, tremelimumab, nivolumab, pemrolizumab, pidilizumab, MPDL3280A, MED14736, MSB0010718C, MK-3475, or BMS-936559, for the treatment of a disease or disorder (e.g., cancer).

In some embodiments, the immune-targeting agent is a cytokine. In some cases, cytokine is further subgrouped into chemokine, interferon, interleukin, and tumor necrosis factor. In some embodiments, chemokine plays a role as a chemoattractant to guide the migration of cells, and is classified into four subfamilies: CXC, CC, CX3C, and XC. Exemplary chemokines include chemokines from the CC subfamily: CCL1, CCL2 (MCP-1), CCL3, CCL4, CCL5 (RANTES), CCL6, CCL7, CCL8, CCL9 (or CCL10), CCL11, CCL12, CCL13, CCL14, CCL15, CCL16, CCL17, CCL18, CCL19, CCL20, CCL21, CCL22, CCL23, CCL24, CCL25, CCL26, CCL27, and CCL28; the CXC subfamily: CXCL1, CXCL2, CXCL3, CXCL4, CXCL5, CXCL6, CXCL7, CXCL8, CXCL9, CXCL10, CXCL1, CXCL12, CXCL13, CXCL14, CXCL15, CXCL16, and CXCL17; the XC subfamily: XCL1 and XCL2; and the CX3C subfamily CX3CL1.

Interferon (IFNs) comprises interferon type I (e.g. IFN-α, IFN-β, IFN-ε, IFN-κ, and IFN-ω), interferon type II (e.g. IFN-γ), and interferon type III. In some embodiments, IFN-α is further classified into about 13 subtypes which include IFNA1, IFNA2, IFNA4, IFNA5, IFNA6, IFNA7, IFNA8, IFNA10, IFNA13, IFNA14, IFNA16, IFNA17, and IFNA21.

Interleukin is expressed by leukocyte or white blood cell and promote the development and differentiation of T and B lymphocytes and hematopoietic cells. Exemplary interleukins include IL-1, IL-2, IL-3, IL-4, IL-5, IL-6, IL-7, IL-8 (CXCL8), IL-9, IL-10, IL-11, IL-12, IL-13, IL-14, IL-15, IL-16, IL-17, IL-18, IL-19, IL-20, IL-21, IL-22, IL-23, IL-24, IL-25, IL-26, IL-27, IL-28, IL-29, IL-30, IL-31, IL-32, IL-33, IL-35, and IL-36.

Tumor necrosis factors (TNFs) are a group of cytokines that modulate apoptosis. In some instances, there are about 19 members within the TNF family, including, not limited to, TNFα, lymphotoxin-alpha (LT-alpha), lymphotoxin-beta (LT-beta), T cell antigen gp39 (CD40L), CD27L, CD30L, FASL, 4-1BBL, OX40L, and TNF-related apoptosis inducing ligand (TRAIL).

In some embodiments, a molecule of Formula (I) in combination with a cytokine is used for the treatment of a disease or disorder (e.g., cancer). In some cases, a molecule of Formula (I) in combination with a chemokine is used for the treatment of a disease or disorder (e.g., cancer). In some cases, a molecule of Formula (I) in combination with an interferon is used for the treatment of a disease or disorder (e.g., cancer). In some cases, a molecule of Formula (I) in combination with an interleukin is used for the treatment of a disease or disorder (e.g., cancer). In some cases, a molecule of Formula (I) in combination with a tumor necrosis factor is used for the treatment of a disease or disorder (e.g., cancer). In some instances, a molecule of Formula (I) in combination with IL-1β, IL-2, IL-7, IL-8, IL-15, MCP-1 (CCL2), MIP-1α, RANTES, MCP-3, MIP5, CCL19, CCL21, CXCL2, CXCL9, CXCL10, or CXCL11 is used for the treatment of a disease or disorder (e.g., cancer).

In some embodiments, the composition or a pharmaceutical formulation described herein comprises a vaccine. In some instances, the vaccine is an in situ vaccination. In some instances, the vaccine is a cell-based vaccine. In some instances, the vaccine is a non-cell based vaccine. In some instances, a molecule of Formula (I) in combination with dendritic cell-based vaccine is used for the treatment of a disease or disorder (e.g., cancer). In some instances, a molecule of Formula (I) in combination with tumor cell-based vaccine is used for the treatment of a disease or disorder (e.g., cancer). In some instances, a molecule of Formula (I) in combination with antigen vaccine is used for the treatment of a disease or disorder (e.g., cancer). In some instances, a molecule of Formula (I) in combination with anti-idiotype vaccine is used for the treatment of a disease or disorder (e.g., cancer). In some instances, a molecule of Formula (I) in combination with DNA vaccine is used for the treatment of a disease or disorder (e.g., cancer). In some instances, a molecule of Formula (I) in combination with vector-based vaccine is used for the treatment of a disease or disorder (e.g., cancer).

In some embodiments, a composition or a pharmaceutical formulation described herein is used as a passive immuno-oncology therapy method for the treatment of a disease or disorder (e.g., cancer). The passive method, in some instances, utilizes adoptive immune system components such as T cells, natural killer (NK) T cells, and/or chimeric antigen receptor (CAR) T cells generated exogenously to attack cancer cells.

In some embodiments, a molecule of Formula (I) in combination with a T-cell based therapeutic agent is used for the treatment of a disease or disorder (e.g., cancer). In some cases, the T-cell based therapeutic agent is an activated T-cell agent that recognizes one or more of a CD cell surface marker described above. In some instances, the T-cell based therapeutic agent comprises an activated T-cell agent that recognizes one or more of CD2, CD3, CD4, CD5, CD8, CD27, CD28, CD80, CD134, CD137, CD152, CD154, CD160, CD200R, CD223, CD226, CD244, CD258, CD267, CD272, CD274, CD278, CD279, or CD357. In some instances, a molecule of Formula (I) in combination with an activated T-cell agent recognizing one or more of CD2, CD3, CD4, CD5, CD8, CD27, CD28, CD80, CD134, CD137, CD152, CD154, CD160, CD200R, CD223, CD226, CD244, CD258, CD267, CD272, CD274, CD278, CD279, or CD357 is used for the treatment of a disease or disorder (e.g., cancer).

In some embodiments, a molecule of Formula (I) in combination with natural killer (NK) T cell-based therapeutic agent is used for the treatment of a disease or disorder (e.g., cancer). In some instances, the NK-based therapeutic agent is an activated NK agent that recognizes one or more of a CD cell surface marker described above. In some cases, the NK-based therapeutic agent is an activated NK agent that recognizes one or more of CD2, CD11a, CD11b, CD16, CD56, CD58, CD62L, CD85j, CD158a/b, CD158c, CD158e/f/k, CD158h/j, CD159a, CD162, CD226, CD314, CD335, CD337, CD244, or CD319. In some instances, a molecule of Formula (I) in combination with an activated NK agent recognizing one or more of CD2, CD11a, CD11b, CD16, CD56, CD58, CD62L, CD85j, CD158a/b, CD158c, CD158e/f/k, CD158h/j, CD159a, CD162, CD226, CD314, CD335, CD337, CD244, or CD319 is used for the treatment of a disease or disorder (e.g., cancer).

In some embodiments, a molecule of Formula (I) in combination with CAR-T cell-based therapeutic agent is used for the treatment of a disease or disorder (e.g., cancer).

In some embodiments, a molecule of Formula (I) in combination with an additional agent that destabilizes the endosomal membrane (or disrupts the endosomal-lysosomal membrane trafficking) is used for the treatment of a disease or disorder (e.g., cancer). In some instances, the additional agent comprises an antimitotic agent. Exemplary antimitotic agents include, but are not limited to, taxanes such as paclitaxel and docetaxel; vinca alkaloids such as vinblastine, vincristine, vindesine, and vinorelbine; cabazitaxel; colchicine; eribulin; estramustine; etoposide; ixabepilone; podophyllotoxin; teniposide; or griseofulvin. In some instances, the additional agent comprises paclitaxel, docetaxel, vinblastine, vincristine, vindesine, vinorelbine, cabazitaxel, colchicine, eribulin, estramustine, etoposide, ixabepilone, podophyllotoxin, teniposide, or griseofulvin. In some instances, the additional agent comprises taxol. In some instances, the additional agent comprises paclitaxel. In some instances, the additional agent comprises etoposide. In other instances, the additional agent comprises vitamin K3.

In some embodiments, a composition or a pharmaceutical formulation described herein is used as a combinatory method (including for both active and passive methods) in the treatment of a disease or disorder (e.g., cancer).

Pharmaceutical Formulation

In some embodiments, the pharmaceutical formulations described herein are administered to a subject by multiple administration routes, including but not limited to, parenteral (e.g., intravenous, subcutaneous, intramuscular), oral, intranasal, buccal, rectal, or transdermal administration routes. In some instances, the pharmaceutical composition describe herein is formulated for parenteral (e.g., intravenous, subcutaneous, intramuscular) administration. In other instances, the pharmaceutical composition describe herein is formulated for oral administration. In still other instances, the pharmaceutical composition describe herein is formulated for intranasal administration.

In some embodiments, the pharmaceutical formulations include, but are not limited to, aqueous liquid dispersions, self-emulsifying dispersions, solid solutions, liposomal dispersions, aerosols, solid dosage forms, powders, immediate-release formulations, controlled-release formulations, fast melt formulations, tablets, capsules, pills, delayed release formulations, extended release formulations, pulsatile release formulations, multiparticulate formulations (e.g., nanoparticle formulations), and mixed immediate and controlled release formulations.

In some instances, the pharmaceutical formulation includes multiparticulate formulations. In some instances, the pharmaceutical formulation includes nanoparticle formulations. In some instances, nanoparticles comprise cMAP, cyclodextrin, or lipids. In some cases, nanoparticles comprise solid lipid nanoparticles, polymeric nanoparticles, self-emulsifying nanoparticles, liposomes, microemulsions, or micellar solutions. Additional exemplary nanoparticles include, but are not limited to, paramagnetic nanoparticles, superparamagnetic nanoparticles, metal nanoparticles, fullerene-like materials, inorganic nanotubes, dendrimers (such as with covalently attached metal chelates), nanofibers, nanohorns, nano-onions, nanorods, nanoropes and quantum dots. In some instances, a nanoparticle is a metal nanoparticle, e.g., a nanoparticle of scandium, titanium, vanadium, chromium, manganese, iron, cobalt, nickel, copper, zinc, yttrium, zirconium, niobium, molybdenum, ruthenium, rhodium, palladium, silver, cadmium, hafnium, tantalum, tungsten, rhenium, osmium, iridium, platinum, gold, gadolinium, aluminum, gallium, indium, tin, thallium, lead, bismuth, magnesium, calcium, strontium, barium, lithium, sodium, potassium, boron, silicon, phosphorus, germanium, arsenic, antimony, and combinations, alloys or oxides thereof.

In some instances, a nanoparticle includes a core or a core and a shell, as in a core-shell nanoparticle.

In some instances, a nanoparticle is further coated with molecules for attachment of functional elements (e.g., with one or more of a polynucleic acid molecule or binding moiety described herein). In some instances, a coating comprises chondroitin sulfate, dextran sulfate, carboxymethyl dextran, alginic acid, pectin, carragheenan, fucoidan, agaropectin, porphyran, karaya gum, gellan gum, xanthan gum, hyaluronic acids, glucosamine, galactosamine, chitin (or chitosan), polyglutamic acid, polyaspartic acid, lysozyme, cytochrome C, ribonuclease, trypsinogen, chymotrypsinogen, α-chymotrypsin, polylysine, polyarginine, histone, protamine, ovalbumin, dextrin, or cyclodextrin. In some instances, a nanoparticle comprises a graphene-coated nanoparticle.

In some cases, a nanoparticle has at least one dimension of less than about 500 nm, 400 nm, 300 nm, 200 nm, or 100 nm.

In some instances, the nanoparticle formulation comprises paramagnetic nanoparticles, superparamagnetic nanoparticles, metal nanoparticles, fullerene-like materials, inorganic nanotubes, dendrimers (such as with covalently attached metal chelates), nanofibers, nanohorns, nano-onions, nanorods, nanoropes or quantum dots. In some instances, a polynucleic acid molecule or a binding moiety described herein is conjugated either directly or indirectly to the nanoparticle. In some instances, at least 1, 5, 10, 15, 20, 30, 40, 50, 60, 70, 80, 90, 100, or more polynucleic acid molecules or binding moieties described herein are conjugated either directly or indirectly to a nanoparticle.

In some embodiments, the pharmaceutical formulations include a carrier or carrier materials selected on the basis of compatibility with the composition disclosed herein, and the release profile properties of the desired dosage form. Exemplary carrier materials include, e.g., binders, suspending agents, disintegration agents, filling agents, surfactants, solubilizers, stabilizers, lubricants, wetting agents, diluents, and the like. Pharmaceutically compatible carrier materials include, but are not limited to, acacia, gelatin, colloidal silicon dioxide, calcium glycerophosphate, calcium lactate, maltodextrin, glycerine, magnesium silicate, polyvinylpyrrollidone (PVP), cholesterol, cholesterol esters, sodium caseinate, soy lecithin, taurocholic acid, phosphotidylcholine, sodium chloride, tricalcium phosphate, dipotassium phosphate, cellulose and cellulose conjugates, sugars sodium stearoyl lactylate, carrageenan, monoglyceride, diglyceride, pregelatinized starch, and the like. See, e.g., *Remington: The Science and Practice of Pharmacy*, Nineteenth Ed (Easton, Pa.: Mack Publishing Company, 1995); Hoover, John E., *Remington's Pharmaceutical Sciences*, Mack Publishing Co., Easton, Pa. 1975; Liberman, H. A. and Lachman, L., Eds., *Pharmaceutical Dosage Forms*, Marcel Decker, New York, N.Y., 1980; and *Pharmaceutical Dosage Forms and Drug Delivery Systems*, Seventh Ed. (Lippincott Williams & Wilkins 1999).

In some instances, the pharmaceutical formulations further include pH-adjusting agents or buffering agents which include acids such as acetic, boric, citric, lactic, phosphoric and hydrochloric acids; bases such as sodium hydroxide, sodium phosphate, sodium borate, sodium citrate, sodium acetate, sodium lactate and tris-hydroxymethylaminomethane; and buffers such as citrate/dextrose, sodium bicarbonate and ammonium chloride. Such acids, bases and buffers are included in an amount required to maintain pH of the composition in an acceptable range.

In some instances, the pharmaceutical formulation includes one or more salts in an amount required to bring osmolality of the composition into an acceptable range. Such salts include those having sodium, potassium or ammonium cations and chloride, citrate, ascorbate, borate, phosphate, bicarbonate, sulfate, thiosulfate or bisulfite anions; suitable salts include sodium chloride, potassium chloride, sodium thiosulfate, sodium bisulfite and ammonium sulfate.

In some instances, the pharmaceutical formulations further include diluent which are used to stabilize compounds because they can provide a more stable environment. Salts dissolved in buffered solutions (which also can provide pH control or maintenance) are utilized as diluents in the art, including, but not limited to a phosphate buffered saline solution. In certain instances, diluents increase bulk of the composition to facilitate compression or create sufficient bulk for homogenous blend for capsule filling. Such compounds can include e.g., lactose, starch, mannitol, sorbitol, dextrose, microcrystalline cellulose such as Avicel®; dibasic calcium phosphate, dicalcium phosphate dihydrate; tricalcium phosphate, calcium phosphate; anhydrous lactose, spray-dried lactose; pregelatinized starch, compressible sugar, such as Di-Pac® (Amstar); mannitol, hydroxypropylmethylcellulose, hydroxypropylmethylcellulose acetate stearate, sucrose-based diluents, confectioner's sugar; monobasic calcium sulfate monohydrate, calcium sulfate dihydrate; calcium lactate trihydrate, dextrates; hydrolyzed cereal solids, amylose; powdered cellulose, calcium carbonate; glycine, kaolin; mannitol, sodium chloride; inositol, bentonite, and the like.

In some cases, the pharmaceutical formulations include disintegration agents or disintegrants to facilitate the breakup or disintegration of a substance. The term "disintegrate" include both the dissolution and dispersion of the dosage form when contacted with gastrointestinal fluid. Examples of disintegration agents include a starch, e.g., a natural starch such as corn starch or potato starch, a pregelatinized starch such as National 1551 or Amijel®, or sodium starch glycolate such as Promogel® or Explotab®, a cellulose such as a wood product, methylcrystalline cellulose, e.g., Avicel®, Avicel® PH101, Avicel® PH102, Avicel® PH105, Elcema® P100, Emcocel®, Vivacel®, Ming Tia®, and Solka-Floc®, methylcellulose, croscarmellose, or a cross-linked cellulose, such as cross-linked sodium carboxymethylcellulose (Ac-Di-Sol®), cross-linked carboxymethylcellulose, or cross-linked croscarmellose, a cross-linked starch such as sodium starch glycolate, a cross-linked polymer such as crospovidone, a cross-linked polyvinylpyrrolidone, alginate such as alginic acid or a salt of alginic acid such as sodium alginate, a clay such as Veegum® HV (magnesium aluminum silicate), a gum such as agar, guar, locust bean, Karaya, pectin, or tragacanth, sodium starch glycolate, bentonite, a natural sponge, a surfactant, a resin such as a cation-exchange resin, citrus pulp, sodium lauryl sulfate, sodium lauryl sulfate in combination starch, and the like.

In some instances, the pharmaceutical formulations include filling agents such as lactose, calcium carbonate, calcium phosphate, dibasic calcium phosphate, calcium sulfate, microcrystalline cellulose, cellulose powder, dextrose, dextrates, dextran, starches, pregelatinized starch, sucrose, xylitol, lactitol, mannitol, sorbitol, sodium chloride, polyethylene glycol, and the like.

Lubricants and glidants are also optionally included in the pharmaceutical formulations described herein for preventing, reducing or inhibiting adhesion or friction of materials. Exemplary lubricants include, e.g., stearic acid, calcium hydroxide, talc, sodium stearyl fumerate, a hydrocarbon such as mineral oil, or hydrogenated vegetable oil such as hydrogenated soybean oil (Sterotex®), higher fatty acids and their alkali-metal and alkaline earth metal salts, such as aluminum, calcium, magnesium, zinc, stearic acid, sodium stearates, glycerol, talc, waxes, Stearowet®, boric acid, sodium benzoate, sodium acetate, sodium chloride, leucine, a polyethylene glycol (e.g., PEG-4000) or a methoxypolyethylene glycol such as Carbowax™, sodium oleate, sodium benzoate, glyceryl behenate, polyethylene glycol, magnesium or sodium lauryl sulfate, colloidal silica such as Syloid™, Cab-O-Sil®, a starch such as corn starch, silicone oil, a surfactant, and the like.

Plasticizers include compounds used to soften the microencapsulation material or film coatings to make them less brittle. Suitable plasticizers include, e.g., polyethylene glycols such as PEG 300, PEG 400, PEG 600, PEG 1450, PEG 3350, and PEG 800, stearic acid, propylene glycol, oleic acid, triethyl cellulose and triacetin. Plasticizers can also function as dispersing agents or wetting agents.

Solubilizers include compounds such as triacetin, triethylcitrate, ethyl oleate, ethyl caprylate, sodium lauryl sulfate, sodium doccusate, vitamin E TPGS, dimethylacetamide, N-methylpyrrolidone, N-hydroxyethylpyrrolidone, polyvinylpyrrolidone, hydroxypropylmethyl cellulose, hydroxypropyl cyclodextrins, ethanol, n-butanol, isopropyl alcohol, cholesterol, bile salts, polyethylene glycol 200-600, glycofurol, transcutol, propylene glycol, dimethyl isosorbide, and the like.

Stabilizers include compounds such as any antioxidation agents, buffers, acids, preservatives and the like.

Suspending agents include compounds such as polyvinylpyrrolidone, e.g., polyvinylpyrrolidone K12, polyvinylpyrrolidone K17, polyvinylpyrrolidone K25, or polyvinylpyrrolidone K30, vinyl pyrrolidone/vinyl acetate copolymer (S630), polyethylene glycol, e.g., the polyethylene glycol can have a molecular weight of about 300 to about 6000, or about 3350 to about 4000, or about 7000 to about 5400, sodium carboxymethylcellulose, methylcellulose, hydroxypropylmethylcellulose, hydroxymethylcellulose acetate stearate, polysorbate-80, hydroxyethylcellulose, sodium alginate, gums, such as, e.g., gum tragacanth and gum acacia, guar gum, xanthans, including xanthan gum, sugars, cellulosics, such as, e.g., sodium carboxymethylcellulose, methylcellulose, sodium carboxymethylcellulose, hydroxypropylmethylcellulose, hydroxyethylcellulose, polysorbate-80, sodium alginate, polyethoxylated sorbitan monolaurate, polyethoxylated sorbitan monolaurate, povidone and the like.

Surfactants include compounds such as sodium lauryl sulfate, sodium docusate, Tween 60 or 80, triacetin, vitamin E TPGS, sorbitan monooleate, polyoxyethylene sorbitan monooleate, polysorbates, polaxomers, bile salts, glyceryl monostearate, copolymers of ethylene oxide and propylene oxide, e.g., Pluronic® (BASF), and the like. Additional surfactants include polyoxyethylene fatty acid glycerides and vegetable oils, e.g., polyoxyethylene (60) hydrogenated castor oil; and polyoxyethylene alkylethers and alkylphenyl ethers, e.g., octoxynol 10, octoxynol 40. Sometimes, surfactants is included to enhance physical stability or for other purposes.

Viscosity enhancing agents include, e.g., methyl cellulose, xanthan gum, carboxymethyl cellulose, hydroxypropyl cellulose, hydroxypropylmethyl cellulose, hydroxypropylmethyl cellulose acetate stearate, hydroxypropylmethyl cellulose phthalate, carbomer, polyvinyl alcohol, alginates, acacia, chitosans and combinations thereof.

Wetting agents include compounds such as oleic acid, glyceryl monostearate, sorbitan monooleate, sorbitan monolaurate, triethanolamine oleate, polyoxyethylene sorbitan monooleate, polyoxyethylene sorbitan monolaurate, sodium docusate, sodium oleate, sodium lauryl sulfate, sodium doccusate, triacetin, Tween 80, vitamin E TPGS, ammonium salts and the like.

Therapeutic Regimens

In some embodiments, the pharmaceutical compositions described herein are administered for therapeutic applications. In some embodiments, the pharmaceutical composition is administered once per day, twice per day, three times per day or more. The pharmaceutical composition is administered daily, every day, every alternate day, five days a week, once a week, every other week, two weeks per month, three weeks per month, once a month, twice a month, three times per month, or more. The pharmaceutical composition is administered for at least 1 month, 2 months, 3 months, 4 months, 5 months, 6 months, 7 months, 8 months, 9 months, 10 months, 11 months, 12 months, 18 months, 2 years, 3 years, or more.

In some embodiments, one or more pharmaceutical compositions are administered simultaneously, sequentially, or at an interval period of time. In some embodiments, one or more pharmaceutical compositions are administered simultaneously. In some cases, one or more pharmaceutical compositions are administered sequentially. In additional cases, one or more pharmaceutical compositions are administered at an interval period of time (e.g., the first administration of a first pharmaceutical composition is on day one followed by an interval of at least 1, 2, 3, 4, 5, or more days prior to the administration of at least a second pharmaceutical composition).

In some embodiments, two or more different pharmaceutical compositions are coadministered. In some instances, the two or more different pharmaceutical compositions are coadministered simultaneously. In some cases, the two or more different pharmaceutical compositions are coadministered sequentially without a gap of time between administrations. In other cases, the two or more different pharmaceutical compositions are coadministered sequentially with a gap of about 0.5 hour, 1 hour, 2 hour, 3 hour, 12 hours, 1 day, 2 days, or more between administrations.

In the case wherein the patient's status does improve, upon the doctor's discretion the administration of the composition is given continuously; alternatively, the dose of the composition being administered is temporarily reduced or temporarily suspended for a certain length of time (i.e., a "drug holiday"). In some instances, the length of the drug holiday varies between 2 days and 1 year, including by way of example only, 2 days, 3 days, 4 days, 5 days, 6 days, 7 days, 10 days, 12 days, 15 days, 20 days, 28 days, 35 days, 50 days, 70 days, 100 days, 120 days, 150 days, 180 days, 200 days, 250 days, 280 days, 300 days, 320 days, 350 days, or 365 days. The dose reduction during a drug holiday is from 10%-100%, including, by way of example only, 10%, 15%, 20%, 25%, 30%, 35%, 40%, 45%, 50%, 55%, 60%, 65%, 70%, 75%, 80%, 85%, 90%, 95%, or 100%.

Once improvement of the patient's conditions has occurred, a maintenance dose is administered if necessary. Subsequently, the dosage or the frequency of administration, or both, are optionally reduced, as a function of the symptoms, to a level at which the improved disease, disorder or condition is retained.

In some embodiments, the amount of a given agent that correspond to such an amount varies depending upon factors such as the particular compound, the severity of the disease, the identity (e.g., weight) of the subject or host in need of treatment, but nevertheless is routinely determined in a manner known in the art according to the particular circumstances surrounding the case, including, e.g., the specific agent being administered, the route of administration, and the subject or host being treated. In some instances, the desired dose is conveniently presented in a single dose or as divided doses administered simultaneously (or over a short period of time) or at appropriate intervals, for example as two, three, four or more sub-doses per day.

The foregoing ranges are merely suggestive, as the number of variables in regard to an individual treatment regime is large, and considerable excursions from these recommended values are not uncommon. Such dosages are altered depending on a number of variables, not limited to the activity of the compound used, the disease or condition to be treated, the mode of administration, the requirements of the individual subject, the severity of the disease or condition being treated, and the judgment of the practitioner.

In some embodiments, toxicity and therapeutic efficacy of such therapeutic regimens are determined by standard pharmaceutical procedures in cell cultures or experimental animals, including, but not limited to, the determination of the LD50 (the dose lethal to 50% of the population) and the ED50 (the dose therapeutically effective in 50% of the population). The dose ratio between the toxic and therapeutic effects is the therapeutic index and it is expressed as the ratio between LD50 and ED50. Compounds exhibiting high therapeutic indices are preferred. The data obtained from cell culture assays and animal studies are used in formulating a range of dosage for use in human. The dosage of such compounds lies preferably within a range of circulating concentrations that include the ED50 with minimal toxicity. The dosage varies within this range depending upon the dosage form employed and the route of administration utilized.

Kits/Article of Manufacture

Disclosed herein, in certain embodiments, are kits and articles of manufacture for use with one or more of the compositions and methods described herein. Such kits include a carrier, package, or container that is compartmentalized to receive one or more containers such as vials, tubes, and the like, each of the container(s) comprising one of the separate elements to be used in a method described herein. Suitable containers include, for example, bottles, vials, syringes, and test tubes. In one embodiment, the containers are formed from a variety of materials such as glass or plastic.

The articles of manufacture provided herein contain packaging materials. Examples of pharmaceutical packaging materials include, but are not limited to, blister packs, bottles, tubes, bags, containers, bottles, and any packaging material suitable for a selected formulation and intended mode of administration and treatment.

For example, the container(s) include a molecule of Formula (I): A-X—B—Y—C, optionally conjugated to an endosomolytic moiety D as disclosed herein. Such kits optionally include an identifying description or label or instructions relating to its use in the methods described herein.

A kit typically includes labels listing contents and/or instructions for use and package inserts with instructions for use. A set of instructions will also typically be included.

In one embodiment, a label is on or associated with the container. In one embodiment, a label is on a container when letters, numbers, or other characters forming the label are attached, molded or etched into the container itself; a label is associated with a container when it is present within a receptacle or carrier that also holds the container, e.g., as a package insert. In one embodiment, a label is used to indicate that the contents are to be used for a specific therapeutic application. The label also indicates directions for use of the contents, such as in the methods described herein.

In certain embodiments, the pharmaceutical compositions are presented in a pack or dispenser device which contains one or more unit dosage forms containing a compound provided herein. The pack, for example, contains metal or plastic foil, such as a blister pack. In one embodiment, the pack or dispenser device is accompanied by instructions for administration. In one embodiment, the pack or dispenser is also accompanied with a notice associated with the container in form prescribed by a governmental agency regulating the manufacture, use, or sale of pharmaceuticals, which notice is reflective of approval by the agency of the form of the drug for human or veterinary administration. Such notice, for example, is the labeling approved by the U.S. Food and Drug Administration for prescription drugs, or the approved product insert. In one embodiment, compositions containing a compound provided herein formulated in a compatible pharmaceutical carrier are also prepared, placed in an appropriate container, and labeled for treatment of an indicated condition.

Certain Terminology

Unless defined otherwise, all technical and scientific terms used herein have the same meaning as is commonly understood by one of skill in the art to which the claimed subject matter belongs. It is to be understood that the foregoing general description and the following detailed description are exemplary and explanatory only and are not restrictive of any subject matter claimed. In this application, the use of the singular includes the plural unless specifically stated otherwise. It must be noted that, as used in the specification and the appended claims, the singular forms "a," "an" and "the" include plural referents unless the context clearly dictates otherwise. In this application, the use of "or" means "and/or" unless stated otherwise. Furthermore, use of the term "including" as well as other forms, such as "include", "includes," and "included," is not limiting.

As used herein, ranges and amounts can be expressed as "about" a particular value or range. About also includes the exact amount. Hence "about 5 μL" means "about 5 μL" and also "5 μL." Generally, the term "about" includes an amount that is expected to be within experimental error.

The section headings used herein are for organizational purposes only and are not to be construed as limiting the subject matter described.

As used herein, the terms "individual(s)", "subject(s)" and "patient(s)" mean any mammal. In some embodiments, the mammal is a human. In some embodiments, the mammal is a non-human. None of the terms require or are limited to situations characterized by the supervision (e.g. constant or intermittent) of a health care worker (e.g. a doctor, a registered nurse, a nurse practitioner, a physician's assistant, an orderly or a hospice worker).

EXAMPLES

These examples are provided for illustrative purposes only and not to limit the scope of the claims provided herein.

Example 1. Sequences

Tables 1, 4, 7, 8, and 10 illustrate target sequences described herein. Tables 2, 3, 5, 6, 9, 11, and 12 illustrate polynucleic acid molecule sequences described herein.

TABLE 1

KRAS Target Sequences

| Id # | sequence position in NM_033360.2 | target site in NM_033360.2 | SEQ ID NO: |
|---|---|---|---|
| 182 | 182-200 | AAAUGACUGAAUAUAAACUUGUG | 1 |
| 183 | 183-201 | AAUGACUGAAUAUAAACUUGUGG | 2 |
| 197 | 197-215 | AACUUGUGGUAGUUGGAGCUGGU | 3 |
| 224 | 224-242 | UAGGCAAGAGUGCCUUGACGAUA | 4 |
| 226 | 226-244 | GGCAAGAGUGCCUUGACGAUACA | 5 |
| 227 | 227-245 | GCAAGAGUGCCUUGACGAUACAG | 6 |
| 228 | 228-246 | CAAGAGUGCCUUGACGAUACAGC | 7 |
| 232 | 232-250 | AGUGCCUUGACGAUACAGCUAAU | 8 |
| 233 | 233-251 | GUGCCUUGACGAUACAGCUAAUU | 9 |
| 236 | 236-254 | CCUUGACGAUACAGCUAAUUCAG | 10 |
| 237 | 237-255 | CUUGACGAUACAGCUAAUUCAGA | 11 |
| 245 | 245-263 | UACAGCUAAUUCAGAAUCAUUUU | 12 |
| 266 | 266-284 | UUGUGGACGAAUAUGAUCCAACA | 13 |
| 269 | 269-287 | UGGACGAAUAUGAUCCAACAAUA | 14 |
| 270 | 270-288 | GGACGAAUAUGAUCCAACAAUAG | 15 |

TABLE 2

KRAS siRNA sequences

| Id # | sequence position in NM_033360.2 | sense strand sequence (5'-3') | SEQ ID NO: | antisense strand sequence (5'-3') | SEQ ID NO: |
|---|---|---|---|---|---|
| 182 | 182-200 | AUGACUGAAUAUAAACUUGTT | 16 | CAAGUUUAUAUUCAGUCAUTT | 17 |
| 183 | 183-201 | UGACUGAAUAUAAACUUGUTT | 18 | ACAAGUUUAUAUUCAGUCATT | 19 |
| 197 | 197-215 | CUUGUGGUAGUUGGAGCUGTT | 20 | CAGCUCCAACUACCACAAGTT | 21 |
| 224 | 224-242 | GGCAAGAGUGCCUUGACGATT | 22 | UCGUCAAGGCACUCUUGCCTT | 23 |
| 226 | 226-244 | CAAGAGUGCCUUGACGAUATT | 24 | UAUCGUCAAGGCACUCUUGTT | 25 |
| 227 | 227-245 | AAGAGUGCCUUGACGAUACTT | 26 | GUAUCGUCAAGGCACUCUUTT | 27 |
| 228 | 228-246 | AGAGUGCCUUGACGAUACATT | 28 | UGUAUCGUCAAGGCACUCUTT | 29 |
| 232 | 232-250 | UGCCUUGACGAUACAGCUATT | 30 | UAGCUGUAUCGUCAAGGCATT | 31 |
| 233 | 233-251 | GCCUUGACGAUACAGCUAATT | 32 | UUAGCUGUAUCGUCAAGGCTT | 33 |
| 236 | 236-254 | UUGACGAUACAGCUAAUUCTT | 34 | GAAUUAGCUGUAUCGUCAATT | 35 |
| 237 | 237-255 | UGACGAUACAGCUAAUUCATT | 36 | UGAAUUAGCUGUAUCGUCATT | 37 |
| 245 | 245-263 | CAGCUAAUUCAGAAUCAUUTT | 38 | AAUGAUUCUGAAUUAGCUGTT | 39 |
| 266 | 266-284 | GUGGACGAAUAUGAUCCAATT | 40 | UUGGAUCAUAUUCGUCCACTT | 41 |
| 269 | 269-287 | GACGAAUAUGAUCCAACAATT | 42 | UUGUUGGAUCAUAUUCGUCTT | 43 |
| 270 | 270-288 | ACGAAUAUGAUCCAACAAUTT | 44 | AUUGUUGGAUCAUAUUCGUTT | 45 |

TABLE 3

KRAS siRNA Sequences with Chemical Modification

| Id # | sequence position in NM_033360.2 | siRNA sequence with chemical modification sense strand sequence (5'-3') | SEQ ID NO: | siRNA sequence with chemical modification antisense strand sequence (5'-3') | SEQ ID NO: |
|---|---|---|---|---|---|
| 182 | 182-200 | auGfaCfuGfaAfuAfuAfaAfcUfuGfdTsdT | 46 | CfAfaGfuUfuAfuAfuUfcAfgUfcAfudTsdT | 47 |
| 183 | 183-201 | ugAfcUfgAfaUfaUfaAfaCfuUfgUfdTsdT | 48 | AfCfaAfgUfuUfaUfaUfuCfaGfuCfadTsdT | 49 |

TABLE 3-continued

KRAS siRNA Sequences with Chemical Modification

| Id # | sequence position in NM_033360.2 | siRNA sequence with chemical modification sense strand sequence (5'-3') | SEQ ID NO: | siRNA sequence with chemical modification antisense strand sequence (5'-3') | SEQ ID NO: |
|---|---|---|---|---|---|
| 197 | 197-215 | cuUfgUfgGfuAfgUfuGfgAfgCfuGfdTsdT | 50 | CfAfgCfuCfcAfaCfuAfcCfaCf aAfgdTsdT | 51 |
| 224 | 224-242 | ggCfaAfgAfgUfgCfcUfuGfaCfgAfdTsdT | 52 | UfCfgUfcAfaGfgCfaCfuCfuUf gCfcdTsdT | 53 |
| 226 | 226-244 | caAfgAfgUfgCfcUfuGfaCfgAfuAfdTsdT | 54 | UfAfuCfgUfcAfaGfgCfaCfuCf uUfgdTsdT | 55 |
| 227 | 227-245 | aaGfaGfuGfcCfuUfgAfcGfaUfaCfdTsdT | 56 | GfUfaUfcGfuCfaAfgGfcAfcUf cUfudTsdT | 57 |
| 228 | 228-246 | agAfgUfgCfcUfuGfaCfgAfuAfcAfdTsdT | 58 | UfGfuAfuCfgUfcAfaGfgCfaCf uCfudTsdT | 59 |
| 232 | 232-250 | ugCfcUfuGfaCfgAfuAfcAfgCfuAfdTsdT | 60 | UfAfgCfuGfuAfuCfgUfcAfaGf gCfadTsdT | 61 |
| 233 | 233-251 | gcCfuUfgAfcGfaUfaCfaGfcUfaAfdTsdT | 62 | UfUfaGfcUfgUfaUfcGfuCfaAf gGfcdTsdT | 63 |
| 236 | 236-254 | uuGfaCfgAfuAfcAfgCfuAfaUfuCfdTsdT | 64 | GfAfaUfuAfgCfuGfuAfuCfgUf cAfadTsdT | 65 |
| 237 | 237-255 | ugAfcGfaUfaCfaGfcUfaAfuUfcAfdTsdT | 66 | UfGfaAfuUfaGfcUfgUfaUfcGf uCfadTsdT | 67 |
| 245 | 245-263 | caGfcUfaAfuUfcAfgAfaUfcAfuUfdTsdT | 68 | AfAfuGfaUfuCfuGfaAfuUfaGf cUfgdTsdT | 69 |
| 266 | 266-284 | guGfgAfcGfaAfuAfuGfaUfcCfaAfdTsdT | 70 | UfUfgGfaUfcAfuAfuUfcGfuCf cAfcdTsdT | 71 |
| 269 | 269-287 | gaCfgAfaUfaUfgAfuCfcAfaCfaAfdTsdT | 72 | UfUfgUfuGfgAfuCfaUfaUfuCf gUfcdTsdT | 73 |
| 270 | 270-288 | acGfaAfuAfuGfaUfcCfaAfcAfaUfdTsdT | 74 | AfUfuGfuUfgGfaUfcAfuAfuU fcGfudTsdT | 75 | siRNA Sequence with Chemical Modification Info
lower case (n) = 2'-O-Me;
Nf = 2'-F;
dT = deoxy-T residue;
s = phosphorothioate backbone modification;
iB = inverted abasic

TABLE 4

EGFR Target Sequences

| hs Id # | 19mer pos. in NM_005228.3 | sequence of total 23mer target site in NM_005228.3 | SEQ ID NO: |
|---|---|---|---|
| 68 | 68-86 | GGCGGCCGGAGUCCCGAGCUAGC | 76 |
| 71 | 71-89 | GGCCGGAGUCCCGAGCUAGCCCC | 77 |
| 72 | 72-90 | GCCGGAGUCCCGAGCUAGCCCCG | 78 |
| 73 | 73-91 | CCGGAGUCCCGAGCUAGCCCCGG | 79 |
| 74 | 74-92 | CGGAGUCCCGAGCUAGCCCCGGC | 80 |
| 75 | 75-93 | GGAGUCCCGAGCUAGCCCCGGCG | 81 |
| 76 | 76-94 | GAGUCCCGAGCUAGCCCCGGCGG | 82 |
| 78 | 78-96 | GUCCCGAGCUAGCCCCGGCGGCC | 83 |

TABLE 4-continued

EGFR Target Sequences

| hs Id # | 19mer pos. in NM_005228.3 | sequence of total 23mer target site in NM_005228.3 | SEQ ID NO: |
|---|---|---|---|
| 114 | 114-132 | CCGGACGACAGGCCACCUCGUCG | 84 |
| 115 | 115-133 | CGGACGACAGGCCACCUCGUCGG | 85 |
| 116 | 116-134 | GGACGACAGGCCACCUCGUCGGC | 86 |
| 117 | 117-135 | GACGACAGGCCACCUCGUCGGCG | 87 |
| 118 | 118-136 | ACGACAGGCCACCUCGUCGGCGU | 88 |
| 120 | 120-138 | GACAGGCCACCUCGUCGGCGUCC | 89 |
| 121 | 121-139 | ACAGGCCACCUCGUCGGCGUCCG | 90 |
| 122 | 122-140 | CAGGCCACCUCGUCGGCGUCCGC | 91 |
| 123 | 123-141 | AGGCCACCUCGUCGGCGUCCGCC | 92 |
| 124 | 124-142 | GGCCACCUCGUCGGCGUCCGCCC | 93 |
| 125 | 125-143 | GCCACCUCGUCGGCGUCCGCCCG | 94 |
| 126 | 126-144 | CCACCUCGUCGGCGUCCGCCCGA | 95 |
| 127 | 127-145 | CACCUCGUCGGCGUCCGCCCGAG | 96 |
| 128 | 128-146 | ACCUCGUCGGCGUCCGCCCGAGU | 97 |
| 129 | 129-147 | CCUCGUCGGCGUCCGCCCGAGUC | 98 |
| 130 | 130-148 | CUCGUCGGCGUCCGCCCGAGUCC | 99 |
| 131 | 131-149 | UCGUCGGCGUCCGCCCGAGUCCC | 100 |
| 132 | 132-150 | CGUCGGCGUCCGCCCGAGUCCCC | 101 |
| 135 | 135-153 | CGGCGUCCGCCCGAGUCCCCGCC | 102 |
| 136 | 136-154 | GGCGUCCGCCCGAGUCCCCGCCU | 103 |
| 141 | 141-159 | CCGCCCGAGUCCCCGCCUCGCCG | 104 |
| 164 | 164-182 | CCAACGCCACAACCACCGCGCAC | 105 |
| 165 | 165-183 | CAACGCCACAACCACCGCGCACG | 106 |
| 166 | 166-184 | AACGCCACAACCACCGCGCACGG | 107 |
| 168 | 168-186 | CGCCACAACCACCGCGCACGGCC | 108 |
| 169 | 169-187 | GCCACAACCACCGCGCACGGCCC | 109 |
| 170 | 170-188 | CCACAACCACCGCGCACGGCCCC | 110 |
| 247 | 247-265 | CGAUGCGACCCUCCGGGACGGCC | 111 |
| 248 | 248-266 | GAUGCGACCCUCCGGGACGGCCG | 112 |
| 249 | 249-267 | AUGCGACCCUCCGGGACGGCCGG | 113 |
| 251 | 251-269 | GCGACCCUCCGGGACGGCCGGGG | 114 |
| 252 | 252-270 | CGACCCUCCGGGACGGCCGGGGC | 115 |
| 254 | 254-272 | ACCCUCCGGGACGGCCGGGGCAG | 116 |
| 329 | 329-347 | AAAGAAAGUUUGCCAAGGCACGA | 117 |
| 330 | 330-348 | AAGAAAGUUUGCCAAGGCACGAG | 118 |
| 332 | 332-350 | GAAAGUUUGCCAAGGCACGAGUA | 119 |
| 333 | 333-351 | AAAGUUUGCCAAGGCACGAGUAA | 120 |
| 334 | 334-352 | AAGUUUGCCAAGGCACGAGUAAC | 121 |

TABLE 4-continued

EGFR Target Sequences

| hs Id # | 19mer pos. in NM_005228.3 | sequence of total 23mer target site in NM_005228.3 | SEQ ID NO: |
|---|---|---|---|
| 335 | 335-353 | AGUUUGCCAAGGCACGAGUAACA | 122 |
| 336 | 336-354 | GUUUGCCAAGGCACGAGUAACAA | 123 |
| 337 | 337-355 | UUUGCCAAGGCACGAGUAACAAG | 124 |
| 338 | 338-356 | UUGCCAAGGCACGAGUAACAAGC | 125 |
| 361 | 361-379 | UCACGCAGUUGGGCACUUUUGAA | 126 |
| 362 | 362-380 | CACGCAGUUGGGCACUUUUGAAG | 127 |
| 363 | 363-381 | ACGCAGUUGGGCACUUUUGAAGA | 128 |
| 364 | 364-382 | CGCAGUUGGGCACUUUUGAAGAU | 129 |
| 365 | 365-383 | GCAGUUGGGCACUUUUGAAGAUC | 130 |
| 366 | 366-384 | CAGUUGGGCACUUUUGAAGAUCA | 131 |
| 367 | 367-385 | AGUUGGGCACUUUUGAAGAUCAU | 132 |
| 368 | 368-386 | GUUGGGCACUUUUGAAGAUCAUU | 133 |
| 369 | 369-387 | UUGGGCACUUUUGAAGAUCAUUU | 134 |
| 377 | 377-395 | UUUUGAAGAUCAUUUCUCAGCC | 135 |
| 379 | 379-397 | UUGAAGAUCAUUUCUCAGCCUC | 136 |
| 380 | 380-398 | UGAAGAUCAUUUCUCAGCCUCC | 137 |
| 385 | 385-403 | AUCAUUUCUCAGCCUCCAGAGG | 138 |
| 394 | 394-412 | UCAGCCUCCAGAGGAUGUUCAAU | 139 |
| 396 | 396-414 | AGCCUCCAGAGGAUGUUCAAUAA | 140 |
| 397 | 397-415 | GCCUCCAGAGGAUGUUCAAUAAC | 141 |
| 401 | 401-419 | CCAGAGGAUGUUCAAUAACUGUG | 142 |
| 403 | 403-421 | AGAGGAUGUUCAAUAACUGUGAG | 143 |
| 407 | 407-425 | GAUGUUCAAUAACUGUGAGGUGG | 144 |
| 409 | 409-427 | UGUUCAAUAACUGUGAGGUGGUC | 145 |
| 410 | 410-428 | GUUCAAUAACUGUGAGGUGGUCC | 146 |
| 411 | 411-429 | UUCAAUAACUGUGAGGUGGUCCU | 147 |
| 412 | 412-430 | UCAAUAACUGUGAGGUGGUCCUU | 148 |
| 413 | 413-431 | CAAUAACUGUGAGGUGGUCCUUG | 149 |
| 414 | 414-432 | AAUAACUGUGAGGUGGUCCUUGG | 150 |
| 416 | 416-434 | UAACUGUGAGGUGGUCCUUGGGA | 151 |
| 418 | 418-436 | ACUGUGAGGUGGUCCUUGGGAAU | 152 |
| 419 | 419-437 | CUGUGAGGUGGUCCUUGGGAAUU | 153 |
| 425 | 425-443 | GGUGGUCCUUGGGAAUUUGGAAA | 154 |
| 431 | 431-449 | CCUUGGGAAUUUGGAAAUUACCU | 155 |
| 432 | 432-450 | CUUGGGAAUUUGGAAAUUACCUA | 156 |
| 433 | 433-451 | UUGGGAAUUUGGAAAUUACCUAU | 157 |
| 434 | 434-452 | UGGGAAUUUGGAAAUUACCUAUG | 158 |

TABLE 4-continued

EGFR Target Sequences

| hs Id # | 19mer pos. in NM_005228.3 | sequence of total 23mer target site in NM_005228.3 | SEQ ID NO: |
|---|---|---|---|
| 458 | 458-476 | GCAGAGGAAUUAUGAUCUUUCCU | 159 |
| 459 | 459-477 | CAGAGGAAUUAUGAUCUUUCCUU | 160 |
| 463 | 463-481 | GGAAUUAUGAUCUUUCCUUCUUA | 161 |
| 464 | 464-482 | GAAUUAUGAUCUUUCCUUCUUAA | 162 |
| 466 | 466-484 | AUUAUGAUCUUUCCUUCUUAAAG | 163 |
| 468 | 468-486 | UAUGAUCUUUCCUUCUUAAAGAC | 164 |
| 471 | 471-489 | GAUCUUUCCUUCUUAAAGACCAU | 165 |
| 476 | 476-494 | UUCCUUCUUAAAGACCAUCCAGG | 166 |
| 477 | 477-495 | UCCUUCUUAAAGACCAUCCAGGA | 167 |
| 479 | 479-497 | CUUCUUAAAGACCAUCCAGGAGG | 168 |
| 481 | 481-499 | UCUUAAAGACCAUCCAGGAGGUG | 169 |
| 482 | 482-500 | CUUAAAGACCAUCCAGGAGGUGG | 170 |
| 492 | 492-510 | AUCCAGGAGGUGGCUGGUUAUGU | 171 |
| 493 | 493-511 | UCCAGGAGGUGGCUGGUUAUGUC | 172 |
| 494 | 494-512 | CCAGGAGGUGGCUGGUUAUGUCC | 173 |
| 495 | 495-513 | CAGGAGGUGGCUGGUUAUGUCCU | 174 |
| 496 | 496-514 | AGGAGGUGGCUGGUUAUGUCCUC | 175 |
| 497 | 497-515 | GGAGGUGGCUGGUUAUGUCCUCA | 176 |
| 499 | 499-517 | AGGUGGCUGGUUAUGUCCUCAUU | 177 |
| 520 | 520-538 | UUGCCCUCAACACAGUGGAGCGA | 178 |
| 542 | 542-560 | AAUUCCUUUGGAAAACCUGCAGA | 179 |
| 543 | 543-561 | AUUCCUUUGGAAAACCUGCAGAU | 180 |
| 550 | 550-568 | UGGAAAACCUGCAGAUCAUCAGA | 181 |
| 551 | 551-569 | GGAAAACCUGCAGAUCAUCAGAG | 182 |
| 553 | 553-571 | AAAACCUGCAGAUCAUCAGAGGA | 183 |
| 556 | 556-574 | ACCUGCAGAUCAUCAGAGGAAAU | 184 |
| 586 | 586-604 | ACGAAAAUUCCUAUGCCUUAGCA | 185 |
| 587 | 587-605 | CGAAAAUUCCUAUGCCUUAGCAG | 186 |
| 589 | 589-607 | AAAAUUCCUAUGCCUUAGCAGUC | 187 |
| 592 | 592-610 | AUUCCUAUGCCUUAGCAGUCUUA | 188 |
| 593 | 593-611 | UUCCUAUGCCUUAGCAGUCUUAU | 189 |
| 594 | 594-612 | UCCUAUGCCUUAGCAGUCUUAUC | 190 |
| 596 | 596-614 | CUAUGCCUUAGCAGUCUUAUCUA | 191 |
| 597 | 597-615 | UAUGCCUUAGCAGUCUUAUCUAA | 192 |
| 598 | 598-616 | AUGCCUUAGCAGUCUUAUCUAAC | 193 |
| 599 | 599-617 | UGCCUUAGCAGUCUUAUCUAACU | 194 |
| 600 | 600-618 | GCCUUAGCAGUCUUAUCUAACUA | 195 |
| 601 | 601-619 | CCUUAGCAGUCUUAUCUAACUAU | 196 |

TABLE 4-continued

EGFR Target Sequences

| hs Id # | 19mer pos. in NM_005228.3 | sequence of total 23mer target site in NM_005228.3 | SEQ ID NO: |
|---|---|---|---|
| 602 | 602-620 | CUUAGCAGUCUUAUCUAACUAUG | 197 |
| 603 | 603-621 | UUAGCAGUCUUAUCUAACUAUGA | 198 |
| 604 | 604-622 | UAGCAGUCUUAUCUAACUAUGAU | 199 |
| 605 | 605-623 | AGCAGUCUUAUCUAACUAUGAUG | 200 |
| 608 | 608-626 | AGUCUUAUCUAACUAUGAUGCAA | 201 |
| 609 | 609-627 | GUCUUAUCUAACUAUGAUGCAAA | 202 |
| 610 | 610-628 | UCUUAUCUAACUAUGAUGCAAAU | 203 |
| 611 | 611-629 | CUUAUCUAACUAUGAUGCAAAUA | 204 |
| 612 | 612-630 | UUAUCUAACUAUGAUGCAAAUAA | 205 |
| 613 | 613-631 | UAUCUAACUAUGAUGCAAAUAAA | 206 |
| 614 | 614-632 | AUCUAACUAUGAUGCAAAUAAAA | 207 |
| 616 | 616-634 | CUAACUAUGAUGCAAAUAAAACC | 208 |
| 622 | 622-640 | AUGAUGCAAAUAAAACCGGACUG | 209 |
| 623 | 623-641 | UGAUGCAAAUAAAACCGGACUGA | 210 |
| 624 | 624-642 | GAUGCAAAUAAAACCGGACUGAA | 211 |
| 626 | 626-644 | UGCAAAUAAAACCGGACUGAAGG | 212 |
| 627 | 627-645 | GCAAAUAAAACCGGACUGAAGGA | 213 |
| 628 | 628-646 | CAAAUAAAACCGGACUGAAGGAG | 214 |
| 630 | 630-648 | AAUAAAACCGGACUGAAGGAGCU | 215 |
| 631 | 631-649 | AUAAAACCGGACUGAAGGAGCUG | 216 |
| 632 | 632-650 | UAAAACCGGACUGAAGGAGCUGC | 217 |
| 633 | 633-651 | AAAACCGGACUGAAGGAGCUGCC | 218 |
| 644 | 644-662 | GAAGGAGCUGCCCAUGAGAAAUU | 219 |
| 665 | 665-683 | UUUACAGGAAAUCCUGCAUGGCG | 220 |
| 668 | 668-686 | ACAGGAAAUCCUGCAUGGCGCCG | 221 |
| 669 | 669-687 | CAGGAAAUCCUGCAUGGCGCCGU | 222 |
| 670 | 670-688 | AGGAAAUCCUGCAUGGCGCCGUG | 223 |
| 671 | 671-689 | GGAAAUCCUGCAUGGCGCCGUGC | 224 |
| 672 | 672-690 | GAAAUCCUGCAUGGCGCCGUGCG | 225 |
| 674 | 674-692 | AAUCCUGCAUGGCGCCGUGCGGU | 226 |
| 676 | 676-694 | UCCUGCAUGGCGCCGUGCGGUUC | 227 |
| 677 | 677-695 | CCUGCAUGGCGCCGUGCGGUUCA | 228 |
| 678 | 678-696 | CUGCAUGGCGCCGUGCGGUUCAG | 229 |
| 680 | 680-698 | GCAUGGCGCCGUGCGGUUCAGCA | 230 |
| 681 | 681-699 | CAUGGCGCCGUGCGGUUCAGCAA | 231 |
| 682 | 682-700 | AUGGCGCCGUGCGGUUCAGCAAC | 232 |
| 683 | 683-701 | UGGCGCCGUGCGGUUCAGCAACA | 233 |

TABLE 4-continued

EGFR Target Sequences

| hs Id # | 19mer pos. in NM_005228.3 | sequence of total 23mer target site in NM_005228.3 | SEQ ID NO: |
|---|---|---|---|
| 684 | 684-702 | GGCGCCGUGCGGUUCAGCAACAA | 234 |
| 685 | 685-703 | GCGCCGUGCGGUUCAGCAACAAC | 235 |
| 686 | 686-704 | CGCCGUGCGGUUCAGCAACAACC | 236 |
| 688 | 688-706 | CCGUGCGGUUCAGCAACAACCCU | 237 |
| 690 | 690-708 | GUGCGGUUCAGCAACAACCCUGC | 238 |
| 692 | 692-710 | GCGGUUCAGCAACAACCCUGCCC | 239 |
| 698 | 698-716 | CAGCAACAACCCUGCCCUGUGCA | 240 |
| 700 | 700-718 | GCAACAACCCUGCCCUGUGCAAC | 241 |
| 719 | 719-737 | CAACGUGGAGAGCAUCCAGUGGC | 242 |
| 720 | 720-738 | AACGUGGAGAGCAUCCAGUGGCG | 243 |
| 721 | 721-739 | ACGUGGAGAGCAUCCAGUGGCGG | 244 |
| 724 | 724-742 | UGGAGAGCAUCCAGUGGCGGGAC | 245 |
| 725 | 725-743 | GGAGAGCAUCCAGUGGCGGGACA | 246 |
| 726 | 726-744 | GAGAGCAUCCAGUGGCGGGACAU | 247 |
| 733 | 733-751 | UCCAGUGGCGGGACAUAGUCAGC | 248 |
| 734 | 734-752 | CCAGUGGCGGGACAUAGUCAGCA | 249 |
| 736 | 736-754 | AGUGGCGGGACAUAGUCAGCAGU | 250 |
| 737 | 737-755 | GUGGCGGGACAUAGUCAGCAGUG | 251 |
| 763 | 763-781 | UUCUCAGCAACAUGUCGAUGGAC | 252 |
| 765 | 765-783 | CUCAGCAACAUGUCGAUGGACUU | 253 |
| 766 | 766-784 | UCAGCAACAUGUCGAUGGACUUC | 254 |
| 767 | 767-785 | CAGCAACAUGUCGAUGGACUUCC | 255 |
| 769 | 769-787 | GCAACAUGUCGAUGGACUUCCAG | 256 |
| 770 | 770-788 | CAACAUGUCGAUGGACUUCCAGA | 257 |
| 771 | 771-789 | AACAUGUCGAUGGACUUCCAGAA | 258 |
| 772 | 772-790 | ACAUGUCGAUGGACUUCCAGAAC | 259 |
| 775 | 775-793 | UGUCGAUGGACUUCCAGAACCAC | 260 |
| 789 | 789-807 | CAGAACCACCUGGGCAGCUGCCA | 261 |
| 798 | 798-816 | CUGGGCAGCUGCCAAAAGUGUGA | 262 |
| 800 | 800-818 | GGGCAGCUGCCAAAAGUGUGAUC | 263 |
| 805 | 805-823 | GCUGCCAAAAGUGUGAUCCAAGC | 264 |
| 806 | 806-824 | CUGCCAAAAGUGUGAUCCAAGCU | 265 |
| 807 | 807-825 | UGCCAAAAGUGUGAUCCAAGCUG | 266 |
| 810 | 810-828 | CAAAAGUGUGAUCCAAGCUGUCC | 267 |
| 814 | 814-832 | AGUGUGAUCCAAGCUGUCCCAAU | 268 |
| 815 | 815-833 | GUGUGAUCCAAGCUGUCCCAAUG | 269 |
| 817 | 817-835 | GUGAUCCAAGCUGUCCCAAUGGG | 270 |
| 818 | 818-836 | UGAUCCAAGCUGUCCCAAUGGGA | 271 |

TABLE 4-continued

EGFR Target Sequences

| hs Id # | 19mer pos. in NM_005228.3 | sequence of total 23mer target site in NM_005228.3 | SEQ ID NO: |
|---|---|---|---|
| 819 | 819-837 | GAUCCAAGCUGUCCCAAUGGGAG | 272 |
| 820 | 820-838 | AUCCAAGCUGUCCCAAUGGGAGC | 273 |
| 821 | 821-839 | UCCAAGCUGUCCCAAUGGGAGCU | 274 |
| 823 | 823-841 | CAAGCUGUCCCAAUGGGAGCUGC | 275 |
| 826 | 826-844 | GCUGUCCCAAUGGGAGCUGCUGG | 276 |
| 847 | 847-865 | GGGGUGCAGGAGAGGAGAACUGC | 277 |
| 871 | 871-889 | AGAAACUGACCAAAAUCAUCUGU | 278 |
| 872 | 872-890 | GAAACUGACCAAAAUCAUCUGUG | 279 |
| 873 | 873-891 | AAACUGACCAAAAUCAUCUGUGC | 280 |
| 877 | 877-895 | UGACCAAAAUCAUCUGUGCCCAG | 281 |
| 878 | 878-896 | GACCAAAAUCAUCUGUGCCCAGC | 282 |
| 881 | 881-899 | CAAAAUCAUCUGUGCCCAGCAGU | 283 |
| 890 | 890-908 | CUGUGCCCAGCAGUGCUCCGGGC | 284 |
| 892 | 892-910 | GUGCCCAGCAGUGCUCCGGGCGC | 285 |
| 929 | 929-947 | CCCCAGUGACUGCUGCCACAACC | 286 |
| 930 | 930-948 | CCCAGUGACUGCUGCCACAACCA | 287 |
| 979 | 979-997 | GGGAGAGCGACUGCCUGGUCUGC | 288 |
| 980 | 980-998 | GGAGAGCGACUGCCUGGUCUGCC | 289 |
| 981 | 981-999 | GAGAGCGACUGCCUGGUCUGCCG | 290 |
| 982 | 982-1000 | AGAGCGACUGCCUGGUCUGCCGC | 291 |
| 983 | 983-1001 | GAGCGACUGCCUGGUCUGCCGCA | 292 |
| 984 | 984-1002 | AGCGACUGCCUGGUCUGCCGCAA | 293 |
| 989 | 989-1007 | CUGCCUGGUCUGCCGCAAAUUCC | 294 |
| 990 | 990-1008 | UGCCUGGUCUGCCGCAAAUUCCG | 295 |
| 991 | 991-1009 | GCCUGGUCUGCCGCAAAUUCCGA | 296 |
| 992 | 992-1010 | CCUGGUCUGCCGCAAAUUCCGAG | 297 |
| 994 | 994-1012 | UGGUCUGCCGCAAAUUCCGAGAC | 298 |
| 995 | 995-1013 | GGUCUGCCGCAAAUUCCGAGACG | 299 |
| 996 | 996-1014 | GUCUGCCGCAAAUUCCGAGACGA | 300 |
| 997 | 997-1015 | UCUGCCGCAAAUUCCGAGACGAA | 301 |
| 999 | 999-1017 | UGCCGCAAAUUCCGAGACGAAGC | 302 |
| 1004 | 1004-1022 | CAAAUUCCGAGACGAAGCCACGU | 303 |
| 1005 | 1005-1023 | AAAUUCCGAGACGAAGCCACGUG | 304 |
| 1006 | 1006-1024 | AAUUCCGAGACGAAGCCACGUGC | 305 |
| 1007 | 1007-1025 | AUUCCGAGACGAAGCCACGUGCA | 306 |
| 1008 | 1008-1026 | UUCCGAGACGAAGCCACGUGCAA | 307 |
| 1010 | 1010-1028 | CCGAGACGAAGCCACGUGCAAGG | 308 |

TABLE 4-continued

EGFR Target Sequences

| hs Id # | 19mer pos. in NM_005228.3 | sequence of total 23mer target site in NM_005228.3 | SEQ ID NO: |
|---|---|---|---|
| 1013 | 1013-1031 | AGACGAAGCCACGUGCAAGGACA | 309 |
| 1014 | 1014-1032 | GACGAAGCCACGUGCAAGGACAC | 310 |
| 1015 | 1015-1033 | ACGAAGCCACGUGCAAGGACACC | 311 |
| 1016 | 1016-1034 | CGAAGCCACGUGCAAGGACACCU | 312 |
| 1040 | 1040-1058 | CCCCCCACUCAUGCUCUACAACC | 313 |
| 1042 | 1042-1060 | CCCCACUCAUGCUCUACAACCCC | 314 |
| 1044 | 1044-1062 | CCACUCAUGCUCUACAACCCCAC | 315 |
| 1047 | 1047-1065 | CUCAUGCUCUACAACCCCACCAC | 316 |
| 1071 | 1071-1089 | UACCAGAUGGAUGUGAACCCCGA | 317 |
| 1073 | 1073-1091 | CCAGAUGGAUGUGAACCCCGAGG | 318 |
| 1074 | 1074-1092 | CAGAUGGAUGUGAACCCCGAGGG | 319 |
| 1075 | 1075-1093 | AGAUGGAUGUGAACCCCGAGGGC | 320 |
| 1077 | 1077-1095 | AUGGAUGUGAACCCCGAGGGCAA | 321 |
| 1078 | 1078-1096 | UGGAUGUGAACCCCGAGGGCAAA | 322 |
| 1080 | 1080-1098 | GAUGUGAACCCCGAGGGCAAAUA | 323 |
| 1084 | 1084-1102 | UGAACCCCGAGGGCAAAUACAGC | 324 |
| 1085 | 1085-1103 | GAACCCCGAGGGCAAAUACAGCU | 325 |
| 1087 | 1087-1105 | ACCCCGAGGGCAAAUACAGCUUU | 326 |
| 1088 | 1088-1106 | CCCCGAGGGCAAAUACAGCUUUG | 327 |
| 1089 | 1089-1107 | CCCGAGGGCAAAUACAGCUUUGG | 328 |
| 1096 | 1096-1114 | GCAAAUACAGCUUUGGUGCCACC | 329 |
| 1097 | 1097-1115 | CAAAUACAGCUUUGGUGCCACCU | 330 |
| 1098 | 1098-1116 | AAAUACAGCUUUGGUGCCACCUG | 331 |
| 1104 | 1104-1122 | AGCUUUGGUGCCACCUGCGUGAA | 332 |
| 1106 | 1106-1124 | CUUUGGUGCCACCUGCGUGAAGA | 333 |
| 1112 | 1112-1130 | UGCCACCUGCGUGAAGAAGUGUC | 334 |
| 1116 | 1116-1134 | ACCUGCGUGAAGAAGUGUCCCCG | 335 |
| 1117 | 1117-1135 | CCUGCGUGAAGAAGUGUCCCCGU | 336 |
| 1118 | 1118-1136 | CUGCGUGAAGAAGUGUCCCCGUA | 337 |
| 1119 | 1119-1137 | UGCGUGAAGAAGUGUCCCCGUAA | 338 |
| 1120 | 1120-1138 | GCGUGAAGAAGUGUCCCCGUAAU | 339 |
| 1121 | 1121-1139 | CGUGAAGAAGUGUCCCCGUAAUU | 340 |
| 1122 | 1122-1140 | GUGAAGAAGUGUCCCCGUAAUUA | 341 |
| 1123 | 1123-1141 | UGAAGAAGUGUCCCCGUAAUUAU | 342 |
| 1124 | 1124-1142 | GAAGAAGUGUCCCCGUAAUUAUG | 343 |
| 1125 | 1125-1143 | AAGAAGUGUCCCCGUAAUUAUGU | 344 |
| 1126 | 1126-1144 | AGAAGUGUCCCCGUAAUUAUGUG | 345 |
| 1127 | 1127-1145 | GAAGUGUCCCCGUAAUUAUGUGG | 346 |

TABLE 4-continued

EGFR Target Sequences

| hs Id # | 19mer pos. in NM_005228.3 | sequence of total 23mer target site in NM_005228.3 | SEQ ID NO: |
|---|---|---|---|
| 1128 | 1128-1146 | AAGUGUCCCCGUAAUUAUGUGGU | 347 |
| 1129 | 1129-1147 | AGUGUCCCCGUAAUUAUGUGGUG | 348 |
| 1130 | 1130-1148 | GUGUCCCCGUAAUUAUGUGGUGA | 349 |
| 1132 | 1132-1150 | GUCCCCGUAAUUAUGUGGUGACA | 350 |
| 1134 | 1134-1152 | CCCCGUAAUUAUGUGGUGACAGA | 351 |
| 1136 | 1136-1154 | CCGUAAUUAUGUGGUGACAGAUC | 352 |
| 1137 | 1137-1155 | CGUAAUUAUGUGGUGACAGAUCA | 353 |
| 1138 | 1138-1156 | GUAAUUAUGUGGUGACAGAUCAC | 354 |
| 1139 | 1139-1157 | UAAUUAUGUGGUGACAGAUCACG | 355 |
| 1140 | 1140-1158 | AAUUAUGUGGUGACAGAUCACGG | 356 |
| 1142 | 1142-1160 | UUAUGUGGUGACAGAUCACGGCU | 357 |
| 1145 | 1145-1163 | UGUGGUGACAGAUCACGGCUCGU | 358 |
| 1147 | 1147-1165 | UGGUGACAGAUCACGGCUCGUGC | 359 |
| 1148 | 1148-1166 | GGUGACAGAUCACGGCUCGUGCG | 360 |
| 1149 | 1149-1167 | GUGACAGAUCACGGCUCGUGCGU | 361 |
| 1150 | 1150-1168 | UGACAGAUCACGGCUCGUGCGUC | 362 |
| 1151 | 1151-1169 | GACAGAUCACGGCUCGUGCGUCC | 363 |
| 1152 | 1152-1170 | ACAGAUCACGGCUCGUGCGUCCG | 364 |
| 1153 | 1153-1171 | CAGAUCACGGCUCGUGCGUCCGA | 365 |
| 1154 | 1154-1172 | AGAUCACGGCUCGUGCGUCCGAG | 366 |
| 1155 | 1155-1173 | GAUCACGGCUCGUGCGUCCGAGC | 367 |
| 1156 | 1156-1174 | AUCACGGCUCGUGCGUCCGAGCC | 368 |
| 1157 | 1157-1175 | UCACGGCUCGUGCGUCCGAGCCU | 369 |
| 1160 | 1160-1178 | CGGCUCGUGCGUCCGAGCCUGUG | 370 |
| 1200 | 1200-1218 | AUGGAGGAAGACGGCGUCCGCAA | 371 |
| 1201 | 1201-1219 | UGGAGGAAGACGGCGUCCGCAAG | 372 |
| 1203 | 1203-1221 | GAGGAAGACGGCGUCCGCAAGUG | 373 |
| 1204 | 1204-1222 | AGGAAGACGGCGUCCGCAAGUGU | 374 |
| 1205 | 1205-1223 | GGAAGACGGCGUCCGCAAGUGUA | 375 |
| 1207 | 1207-1225 | AAGACGGCGUCCGCAAGUGUAAG | 376 |
| 1208 | 1208-1226 | AGACGGCGUCCGCAAGUGUAAGA | 377 |
| 1211 | 1211-1229 | CGGCGUCCGCAAGUGUAAGAAGU | 378 |
| 1212 | 1212-1230 | GGCGUCCGCAAGUGUAAGAAGUG | 379 |
| 1213 | 1213-1231 | GCGUCCGCAAGUGUAAGAAGUGC | 380 |
| 1214 | 1214-1232 | CGUCCGCAAGUGUAAGAAGUGCG | 381 |
| 1215 | 1215-1233 | GUCCGCAAGUGUAAGAAGUGCGA | 382 |
| 1216 | 1216-1234 | UCCGCAAGUGUAAGAAGUGCGAA | 383 |

TABLE 4-continued

EGFR Target Sequences

| hs Id # | 19mer pos. in NM_005228.3 | sequence of total 23mer target site in NM_005228.3 | SEQ ID NO: |
|---|---|---|---|
| 1217 | 1217-1235 | CCGCAAGUGUAAGAAGUGCGAAG | 384 |
| 1219 | 1219-1237 | GCAAGUGUAAGAAGUGCGAAGGG | 385 |
| 1220 | 1220-1238 | CAAGUGUAAGAAGUGCGAAGGGC | 386 |
| 1221 | 1221-1239 | AAGUGUAAGAAGUGCGAAGGGCC | 387 |
| 1222 | 1222-1240 | AGUGUAAGAAGUGCGAAGGGCCU | 388 |
| 1223 | 1223-1241 | GUGUAAGAAGUGCGAAGGGCCUU | 389 |
| 1224 | 1224-1242 | UGUAAGAAGUGCGAAGGGCCUUG | 390 |
| 1225 | 1225-1243 | GUAAGAAGUGCGAAGGGCCUUGC | 391 |
| 1226 | 1226-1244 | UAAGAAGUGCGAAGGGCCUUGCC | 392 |
| 1229 | 1229-1247 | GAAGUGCGAAGGGCCUUGCCGCA | 393 |
| 1230 | 1230-1248 | AAGUGCGAAGGGCCUUGCCGCAA | 394 |
| 1231 | 1231-1249 | AGUGCGAAGGGCCUUGCCGCAAA | 395 |
| 1232 | 1232-1250 | GUGCGAAGGGCCUUGCCGCAAAG | 396 |
| 1233 | 1233-1251 | UGCGAAGGGCCUUGCCGCAAAGU | 397 |
| 1235 | 1235-1253 | CGAAGGGCCUUGCCGCAAAGUGU | 398 |
| 1236 | 1236-1254 | GAAGGGCCUUGCCGCAAAGUGUG | 399 |
| 1237 | 1237-1255 | AAGGGCCUUGCCGCAAAGUGUGU | 400 |
| 1238 | 1238-1256 | AGGGCCUUGCCGCAAAGUGUGUA | 401 |
| 1239 | 1239-1257 | GGGCCUUGCCGCAAAGUGUGUAA | 402 |
| 1241 | 1241-1259 | GCCUUGCCGCAAAGUGUGUAACG | 403 |
| 1261 | 1261-1279 | ACGGAAUAGGUAUUGGUGAAUUU | 404 |
| 1262 | 1262-1280 | CGGAAUAGGUAUUGGUGAAUUUA | 405 |
| 1263 | 1263-1281 | GGAAUAGGUAUUGGUGAAUUUAA | 406 |
| 1264 | 1264-1282 | GAAUAGGUAUUGGUGAAUUUAAA | 407 |
| 1266 | 1266-1284 | AUAGGUAUUGGUGAAUUUAAAGA | 408 |
| 1267 | 1267-1285 | UAGGUAUUGGUGAAUUUAAAGAC | 409 |
| 1289 | 1289-1307 | CUCACUCUCCAUAAAUGCUACGA | 410 |
| 1313 | 1313-1331 | UAUUAAACACUUCAAAAACUGCA | 411 |
| 1320 | 1320-1338 | CACUUCAAAAACUGCACCUCCAU | 412 |
| 1321 | 1321-1339 | ACUUCAAAAACUGCACCUCCAUC | 413 |
| 1322 | 1322-1340 | CUUCAAAAACUGCACCUCCAUCA | 414 |
| 1323 | 1323-1341 | UUCAAAAACUGCACCUCCAUCAG | 415 |
| 1324 | 1324-1342 | UCAAAAACUGCACCUCCAUCAGU | 416 |
| 1328 | 1328-1346 | AAACUGCACCUCCAUCAGUGGCG | 417 |
| 1332 | 1332-1350 | UGCACCUCCAUCAGUGGCGAUCU | 418 |
| 1333 | 1333-1351 | GCACCUCCAUCAGUGGCGAUCUC | 419 |
| 1335 | 1335-1353 | ACCUCCAUCAGUGGCGAUCUCCA | 420 |
| 1338 | 1338-1356 | UCCAUCAGUGGCGAUCUCCACAU | 421 |

TABLE 4-continued

EGFR Target Sequences

| hs Id # | 19mer pos. in NM_005228.3 | sequence of total 23mer target site in NM_005228.3 | SEQ ID NO: |
|---|---|---|---|
| 1344 | 1344-1362 | AGUGGCGAUCUCCACAUCCUGCC | 422 |
| 1345 | 1345-1363 | GUGGCGAUCUCCACAUCCUGCCG | 423 |
| 1346 | 1346-1364 | UGGCGAUCUCCACAUCCUGCCGG | 424 |
| 1347 | 1347-1365 | GGCGAUCUCCACAUCCUGCCGGU | 425 |
| 1348 | 1348-1366 | GCGAUCUCCACAUCCUGCCGGUG | 426 |
| 1353 | 1353-1371 | CUCCACAUCCUGCCGGUGGCAUU | 427 |
| 1354 | 1354-1372 | UCCACAUCCUGCCGGUGGCAUUU | 428 |
| 1355 | 1355-1373 | CCACAUCCUGCCGGUGGCAUUUA | 429 |
| 1357 | 1357-1375 | ACAUCCUGCCGGUGGCAUUUAGG | 430 |
| 1360 | 1360-1378 | UCCUGCCGGUGGCAUUUAGGGGU | 431 |
| 1361 | 1361-1379 | CCUGCCGGUGGCAUUUAGGGGUG | 432 |
| 1362 | 1362-1380 | CUGCCGGUGGCAUUUAGGGGUGA | 433 |
| 1363 | 1363-1381 | UGCCGGUGGCAUUUAGGGGUGAC | 434 |
| 1366 | 1366-1384 | CGGUGGCAUUUAGGGGUGACUCC | 435 |
| 1369 | 1369-1387 | UGGCAUUUAGGGGUGACUCCUUC | 436 |
| 1370 | 1370-1388 | GGCAUUUAGGGGUGACUCCUUCA | 437 |
| 1371 | 1371-1389 | GCAUUUAGGGGUGACUCCUUCAC | 438 |
| 1372 | 1372-1390 | CAUUUAGGGGUGACUCCUUCACA | 439 |
| 1373 | 1373-1391 | AUUUAGGGGUGACUCCUUCACAC | 440 |
| 1374 | 1374-1392 | UUUAGGGGUGACUCCUUCACACA | 441 |
| 1404 | 1404-1422 | CCUCUGGAUCCACAGGAACUGGA | 442 |
| 1408 | 1408-1426 | UGGAUCCACAGGAACUGGAUAUU | 443 |
| 1409 | 1409-1427 | GGAUCCACAGGAACUGGAUAUUC | 444 |
| 1411 | 1411-1429 | AUCCACAGGAACUGGAUAUUCUG | 445 |
| 1412 | 1412-1430 | UCCACAGGAACUGGAUAUUCUGA | 446 |
| 1419 | 1419-1437 | GAACUGGAUAUUCUGAAAACCGU | 447 |
| 1426 | 1426-1444 | AUAUUCUGAAAACCGUAAAGGAA | 448 |
| 1427 | 1427-1445 | UAUUCUGAAAACCGUAAAGGAAA | 449 |
| 1430 | 1430-1448 | UCUGAAAACCGUAAAGGAAAUCA | 450 |
| 1431 | 1431-1449 | CUGAAAACCGUAAAGGAAAUCAC | 451 |

TABLE 5

EGFR siRNA Sequences

| hs Id # | Sequence position in NM_005228.3 | sense strand sequence 5'-3' | SEQ ID NO: | antisense strand sequence 5'-3' | SEQ ID NO: |
|---|---|---|---|---|---|
| 68 | 68-86 | CGGCCGGAGUCCCGAGCUATT | 452 | UAGCUCGGGACUCCGGCCGTT | 453 |

TABLE 5-continued

EGFR siRNA Sequences

| hs Id # | Sequence position in NM_005228.3 | sense strand sequence 5'-3' | SEQ ID NO: | antisense strand sequence 5'-3' | SEQ ID NO: |
|---|---|---|---|---|---|
| 71 | 71-89 | CCGGAGUCCCGAGCUAGCCTT | 454 | GGCUAGCUCGGGACUCCGGTT | 455 |
| 72 | 72-90 | CGGAGUCCCGAGCUAGCCCTT | 456 | GGGCUAGCUCGGGACUCCGTT | 457 |
| 73 | 73-91 | GGAGUCCCGAGCUAGCCCTT | 458 | GGGGCUAGCUCGGGACUCCTT | 459 |
| 74 | 74-92 | GAGUCCCGAGCUAGCCCCGTT | 460 | CGGGGCUAGCUCGGGACUCTT | 461 |
| 75 | 75-93 | AGUCCCGAGCUAGCCCCGGTT | 462 | CCGGGGCUAGCUCGGGACUTT | 463 |
| 76 | 76-94 | GUCCCGAGCUAGCCCCGGCTT | 464 | GCCGGGGCUAGCUCGGGACTT | 465 |
| 78 | 78-96 | CCCGAGCUAGCCCCGGCGGTT | 466 | CCGCCGGGGCUAGCUCGGGTT | 467 |
| 114 | 114-132 | GGACGACAGGCCACCUCGUTT | 468 | ACGAGGUGGCCUGUCGUCCTT | 469 |
| 115 | 115-133 | GACGACAGGCCACCUCGUCTT | 470 | GACGAGGUGGCCUGUCGUCTT | 471 |
| 116 | 116-134 | ACGACAGGCCACCUCGUCGTT | 472 | CGACGAGGUGGCCUGUCGUTT | 473 |
| 117 | 117-135 | CGACAGGCCACCUCGUCGGTT | 474 | CCGACGAGGUGGCCUGUCGTT | 475 |
| 118 | 118-136 | GACAGGCCACCUCGUCGGCTT | 476 | GCCGACGAGGUGGCCUGUCTT | 477 |
| 120 | 120-138 | CAGGCCACCUCGUCGGCGUTT | 478 | ACGCCGACGAGGUGGCCUGTT | 479 |
| 121 | 121-139 | AGGCCACCUCGUCGGCGUCTT | 480 | GACGCCGACGAGGUGGCCUTT | 481 |
| 122 | 122-140 | GGCCACCUCGUCGGCGUCCTT | 482 | GGACGCCGACGAGGUGGCCTT | 483 |
| 123 | 123-141 | GCCACCUCGUCGGCGUCCGTT | 484 | CGGACGCCGACGAGGUGGCTT | 485 |
| 124 | 124-142 | CCACCUCGUCGGCGUCCGCTT | 486 | GCGGACGCCGACGAGGUGGTT | 487 |
| 125 | 125-143 | CACCUCGUCGGCGUCCGCCTT | 488 | GGCGGACGCCGACGAGGUGTT | 489 |
| 126 | 126-144 | ACCUCGUCGGCGUCCGCCCTT | 490 | GGGCGGACGCCGACGAGGUTT | 491 |
| 127 | 127-145 | CCUCGUCGGCGUCCGCCCGTT | 492 | CGGGCGGACGCCGACGAGGTT | 493 |
| 128 | 128-146 | CUCGUCGGCGUCCGCCCGATT | 494 | UCGGGCGGACGCCGACGAGTT | 495 |
| 129 | 129-147 | UCGUCGGCGUCCGCCCGAGTT | 496 | CUCGGGCGGACGCCGACGATT | 497 |
| 130 | 130-148 | CGUCGGCGUCCGCCCGAGUTT | 498 | ACUCGGGCGGACGCCGACGTT | 499 |
| 131 | 131-149 | GUCGGCGUCCGCCCGAGUCTT | 500 | GACUCGGGCGGACGCCGACTT | 501 |
| 132 | 132-150 | UCGGCGUCCGCCCGAGUCCTT | 502 | GGACUCGGGCGGACGCCGATT | 503 |

TABLE 5-continued

EGFR siRNA Sequences

| hs Id # | Sequence position in NM_005228.3 | sense strand sequence 5'-3' | SEQ ID NO: | antisense strand sequence 5'-3' | SEQ ID NO: |
|---|---|---|---|---|---|
| 135 | 135-153 | GCGUCCGCCCGAGUCCCCGTT | 504 | CGGGGACUCGGGCGGACGCTT | 505 |
| 136 | 136-154 | CGUCCGCCCGAGUCCCCGCTT | 506 | GCGGGGACUCGGGCGGACGTT | 507 |
| 141 | 141-159 | GCCCGAGUCCCCGCCUCGCTT | 508 | GCGAGGCGGGGACUCGGGCTT | 509 |
| 164 | 164-182 | AACGCCACAACCACCGCGCTT | 510 | GCGCGGUGGUUGUGGCGUUTT | 511 |
| 165 | 165-183 | ACGCCACAACCACCGCGCATT | 512 | UGCGCGGUGGUUGUGGCGUTT | 513 |
| 166 | 166-184 | CGCCACAACCACCGCGCACTT | 514 | GUGCGCGGUGGUUGUGGCGTT | 515 |
| 168 | 168-186 | CCACAACCACCGCGCACGGTT | 516 | CCGUGCGCGGUGGUUGUGGTT | 517 |
| 169 | 169-187 | CACAACCACCGCGCACGGCTT | 518 | GCCGUGCGCGGUGGUUGUGTT | 519 |
| 170 | 170-188 | ACAACCACCGCGCACGGCCTT | 520 | GGCCGUGCGCGGUGGUUGUTT | 521 |
| 247 | 247-265 | AUGCGACCCUCCGGGACGGTT | 522 | CCGUCCCGGAGGGUCGCAUTT | 523 |
| 248 | 248-266 | UGCGACCCUCCGGGACGGCTT | 524 | GCCGUCCCGGAGGGUCGCATT | 525 |
| 249 | 249-267 | GCGACCCUCCGGGACGGCCTT | 526 | GGCCGUCCCGGAGGGUCGCTT | 527 |
| 251 | 251-269 | GACCCUCCGGGACGGCCGGTT | 528 | CCGGCCGUCCCGGAGGGUCTT | 529 |
| 252 | 252-270 | ACCCUCCGGGACGGCCGGGTT | 530 | CCCGGCCGUCCCGGAGGGUTT | 531 |
| 254 | 254-272 | CCUCCGGGACGGCCGGGGCTT | 532 | GCCCCGGCCGUCCCGGAGGTT | 533 |
| 329 | 329-347 | AGAAAGUUUGCCAAGGCACTT | 534 | GUGCCUUGGCAAACUUUCUTT | 535 |
| 330 | 330-348 | GAAAGUUUGCCAAGGCACGTT | 536 | CGUGCCUUGGCAAACUUUCTT | 537 |
| 332 | 332-350 | AAGUUUGCCAAGGCACGAGTT | 538 | CUCGUGCCUUGGCAAACUUTT | 539 |
| 333 | 333-351 | AGUUUGCCAAGGCACGAGUTT | 540 | ACUCGUGCCUUGGCAAACUTT | 541 |
| 334 | 334-352 | GUUUGCCAAGGCACGAGUATT | 542 | UACUCGUGCCUUGGCAAACTT | 543 |
| 335 | 335-353 | UUUGCCAAGGCACGAGUAATT | 544 | UUACUCGUGCCUUGGCAAATT | 545 |
| 336 | 336-354 | UUGCCAAGGCACGAGUAACTT | 546 | GUUACUCGUGCCUUGGCAATT | 547 |
| 337 | 337-355 | UGCCAAGGCACGAGUAACATT | 548 | UGUUACUCGUGCCUUGGCATT | 549 |
| 338 | 338-356 | GCCAAGGCACGAGUAACAATT | 550 | UUGUUACUCGUGCCUUGGCTT | 551 |

TABLE 5-continued

EGFR siRNA Sequences

| hs Id # | Sequence position in NM_005228.3 | sense strand sequence 5'-3' | SEQ ID NO: | antisense strand sequence 5'-3' | SEQ ID NO: |
|---|---|---|---|---|---|
| 361 | 361-379 | ACGCAGUUGGGCACUU UUGTT | 552 | CAAAAGUGCCCAACUGC GUTT | 553 |
| 362 | 362-380 | CGCAGUUGGGCACUUU UGATT | 554 | UCAAAAGUGCCCAACUG CGTT | 555 |
| 363 | 363-381 | GCAGUUGGGCACUUUU GAATT | 556 | UUCAAAAGUGCCCAACU GCTT | 557 |
| 364 | 364-382 | CAGUUGGGCACUUUUG AAGTT | 558 | CUUCAAAAGUGCCCAAC UGTT | 559 |
| 365 | 365-383 | AGUUGGGCACUUUUGA AGATT | 560 | UCUUCAAAAGUGCCCAA CUTT | 561 |
| 366 | 366-384 | GUUGGGCACUUUUGAA GAUTT | 562 | AUCUUCAAAAGUGCCCA ACTT | 563 |
| 367 | 367-385 | UUGGGCACUUUUGAAG AUCTT | 564 | GAUCUUCAAAAGUGCCC AATT | 565 |
| 368 | 368-386 | UGGGCACUUUUGAAGA UCATT | 566 | UGAUCUUCAAAAGUGCC CATT | 567 |
| 369 | 369-387 | GGGCACUUUUGAAGAU CAUTT | 568 | AUGAUCUUCAAAAGUGC CCTT | 569 |
| 377 | 377-395 | UUGAAGAUCAUUUUCU CAGTT | 570 | CUGAGAAAAUGAUCUUC AATT | 571 |
| 379 | 379-397 | GAAGAUCAUUUUCUCA GCCTT | 572 | GGCUGAGAAAAUGAUCU UCTT | 573 |
| 380 | 380-398 | AAGAUCAUUUUCUCAG CCUTT | 574 | AGGCUGAGAAAAUGAUC UUTT | 575 |
| 385 | 385-403 | CAUUUUCUCAGCCUCC AGATT | 576 | UCUGGAGGCUGAGAAAA UGTT | 577 |
| 394 | 394-412 | AGCCUCCAGAGGAUGU UCATT | 578 | UGAACAUCCUCUGGAGG CUTT | 579 |
| 396 | 396-414 | CCUCCAGAGGAUGUUC AAUTT | 580 | AUUGAACAUCCUCUGGA GGTT | 581 |
| 397 | 397-415 | CUCCAGAGGAUGUUCA AUATT | 582 | UAUUGAACAUCCUCUGG AGTT | 583 |
| 401 | 401-419 | AGAGGAUGUUCAAUAA CUGTT | 584 | CAGUUAUUGAACAUCCU CUTT | 585 |
| 403 | 403-421 | AGGAUGUUCAAUAACU GUGTT | 586 | CACAGUUAUUGAACAUC CUTT | 587 |
| 407 | 407-425 | UGUUCAAUAACUGUGA GGUTT | 588 | ACCUCACAGUUAUUGAA CATT | 589 |
| 409 | 409-427 | UUCAAUAACUGUGAGG UGGTT | 590 | CCACCUCACAGUUAUUG AATT | 591 |
| 410 | 410-428 | UCAAUAACUGUGAGGU GGUTT | 592 | ACCACCUCACAGUUAUU GATT | 593 |
| 411 | 411-429 | CAAUAACUGUGAGGUG GUCTT | 594 | GACCACCUCACAGUUAU UGTT | 595 |
| 412 | 412-430 | AAUAACUGUGAGGUGG UCCTT | 596 | GGACCACCUCACAGUUA UUTT | 597 |
| 413 | 413-431 | AUAACUGUGAGGUGGU CCUTT | 598 | AGGACCACCUCACAGUU AUTT | 599 |

TABLE 5-continued

EGFR siRNA Sequences

| hs Id # | Sequence position in NM_005228.3 | sense strand sequence 5'-3' | SEQ ID NO: | antisense strand sequence 5'-3' | SEQ ID NO: |
|---|---|---|---|---|---|
| 414 | 414-432 | UAACUGUGAGGUGGUCCUUTT | 600 | AAGGACCACCUCACAGUUAUU | 601 |
| 416 | 416-434 | ACUGUGAGGUGGUCCUUGGTT | 602 | CCAAGGACCACCUCACAGUTT | 603 |
| 418 | 418-436 | UGUGAGGUGGUCCUUGGATT | 604 | UCCCAAGGACCACCUCACATT | 605 |
| 419 | 419-437 | GUGAGGUGGUCCUUGGAATT | 606 | UUCCCAAGGACCACCUCACTT | 607 |
| 425 | 425-443 | UGGUCCUUGGGAAUUUGGATT | 608 | UCCAAAUUCCCAAGGACCATT | 609 |
| 431 | 431-449 | UUGGGAAUUUGGAAAUUACTT | 610 | GUAAUUUCCAAAUUCCCAATT | 611 |
| 432 | 432-450 | UGGGAAUUUGGAAAUUACCTT | 612 | GGUAAUUUCCAAAUUCCCATT | 613 |
| 433 | 433-451 | GGGAAUUUGGAAAUUACCUTT | 614 | AGGUAAUUUCCAAAUUCCCTT | 615 |
| 434 | 434-452 | GGAAUUUGGAAAUUACCUATT | 616 | UAGGUAAUUUCCAAAUUCCTT | 617 |
| 458 | 458-476 | AGAGGAAUUAUGAUCUUUCTT | 618 | GAAAGAUCAUAAUUCCUCUTT | 619 |
| 459 | 459-477 | GAGGAAUUAUGAUCUUUCCTT | 620 | GGAAAGAUCAUAAUUCCUCTT | 621 |
| 463 | 463-481 | AAUUAUGAUCUUUCCUUCUTT | 622 | AGAAGGAAAGAUCAUAAUUTT | 623 |
| 464 | 464-482 | AUUAUGAUCUUUCCUUCUUTT | 624 | AAGAAGGAAAGAUCAUAAUTT | 625 |
| 466 | 466-484 | UAUGAUCUUUCCUUCUUAATT | 626 | UUAAGAAGGAAAGAUCAUATT | 627 |
| 468 | 468-486 | UGAUCUUUCCUUCUUAAGTT | 628 | CUUUAAGAAGGAAAGAUCATT | 629 |
| 471 | 471-489 | UCUUUCCUUCUUAAAGACCTT | 630 | GGUCUUUAAGAAGGAAAGAUTT | 631 |
| 476 | 476-494 | CCUUCUUAAAGACCAUCCATT | 632 | UGGAUGGUCUUUAAGAAGGTT | 633 |
| 477 | 477-495 | CUUCUUAAAGACCAUCCAGTT | 634 | CUGGAUGGUCUUUAAGAAGTT | 635 |
| 479 | 479-497 | UCUUAAAGACCAUCCAGGATT | 636 | UCCUGGAUGGUCUUUAAGATT | 637 |
| 481 | 481-499 | UUAAAGACCAUCCAGGAGGTT | 638 | CCUCCUGGAUGGUCUUUAATT | 639 |
| 482 | 482-500 | UAAAGACCAUCCAGGAGGUTT | 640 | ACCUCCUGGAUGGUCUUUATT | 641 |
| 492 | 492-510 | CCAGGAGGUGGCUGGUUAUTT | 642 | AUAACCAGCCACCUCCUGGTT | 643 |
| 493 | 493-511 | CAGGAGGUGGCUGGUUAUGTT | 644 | CAUAACCAGCCACCUCCUGTT | 645 |
| 494 | 494-512 | AGGAGGUGGCUGGUUAUGUTT | 646 | ACAUAACCAGCCACCUCCUTT | 647 |

TABLE 5-continued

EGFR siRNA Sequences

| hs Id # | Sequence position in NM_005228.3 | sense strand sequence 5'-3' | SEQ ID NO: | antisense strand sequence 5'-3' | SEQ ID NO: |
|---|---|---|---|---|---|
| 495 | 495-513 | GGAGGUGGCUGGUUAUGUCTT | 648 | GACAUAACCAGCCACCUCCTT | 649 |
| 496 | 496-514 | GAGGUGGCUGGUUAUGUCCTT | 650 | GGACAUAACCAGCCACCUCTT | 651 |
| 497 | 497-515 | AGGUGGCUGGUUAUGUCCTT | 652 | AGGACAUAACCAGCCACCUTT | 653 |
| 499 | 499-517 | GUGGCUGGUUAUGUCCUCATT | 654 | UGAGGACAUAACCAGCCACTT | 655 |
| 520 | 520-538 | GCCCUCAACACAGUGGAGCTT | 656 | GCUCCACUGUGUUGAGGGCTT | 657 |
| 542 | 542-560 | UUCCUUUGGAAAACCUGCATT | 658 | UGCAGGUUUUCCAAAGGAATT | 659 |
| 543 | 543-561 | UCCUUUGGAAAACCUGCAGTT | 660 | CUGCAGGUUUUCCAAAGGATT | 661 |
| 550 | 550-568 | GAAAACCUGCAGAUCAUCATT | 662 | UGAUGAUCUGCAGGUUUUCTT | 663 |
| 551 | 551-569 | AAAACCUGCAGAUCAUCAGTT | 664 | CUGAUGAUCUGCAGGUUUUTT | 665 |
| 553 | 553-571 | AACCUGCAGAUCAUCAGAGTT | 666 | CUCUGAUGAUCUGCAGGUUTT | 667 |
| 556 | 556-574 | CUGCAGAUCAUCAGAGGAATT | 668 | UUCCUCUGAUGAUCUGCAGTT | 669 |
| 586 | 586-604 | GAAAAUUCCUAUGCCUUAGTT | 670 | CUAAGGCAUAGGAAUUUUCTT | 671 |
| 587 | 587-605 | AAAAUUCCUAUGCCUUAGCTT | 672 | GCUAAGGCAUAGGAAUUUUTT | 673 |
| 589 | 589-607 | AAUUCCUAUGCCUUAGCAGTT | 674 | CUGCUAAGGCAUAGGAAUUTT | 675 |
| 592 | 592-610 | UCCUAUGCCUUAGCAGUCUTT | 676 | AGACUGCUAAGGCAUAGGATT | 677 |
| 593 | 593-611 | CCUAUGCCUUAGCAGUCUUTT | 678 | AAGACUGCUAAGGCAUAGGTT | 679 |
| 594 | 594-612 | CUAUGCCUUAGCAGUCUUATT | 680 | UAAGACUGCUAAGGCAUAGTT | 681 |
| 596 | 596-614 | AUGCCUUAGCAGUCUUAUCTT | 682 | GAUAAGACUGCUAAGGCAUTT | 683 |
| 597 | 597-615 | UGCCUUAGCAGUCUUAUCUTT | 684 | AGAUAAGACUGCUAAGGCATT | 685 |
| 598 | 598-616 | GCCUUAGCAGUCUUAUCUATT | 686 | UAGAUAAGACUGCUAAGGCTT | 687 |
| 599 | 599-617 | CCUUAGCAGUCUUAUCUAATT | 688 | UUAGAUAAGACUGCUAAGGTT | 689 |
| 600 | 600-618 | CUUAGCAGUCUUAUCUAACTT | 690 | GUUAGAUAAGACUGCUAAGTT | 691 |
| 601 | 601-619 | UUAGCAGUCUUAUCUAACATT | 692 | AGUUAGAUAAGACUGCUAATT | 693 |
| 602 | 602-620 | UAGCAGUCUUAUCUAACUATT | 694 | UAGUUAGAUAAGACUGCUATT | 695 |

TABLE 5-continued

EGFR siRNA Sequences

| hs Id # | Sequence position in NM_005228.3 | sense strand sequence 5'-3' | SEQ ID NO: | antisense strand sequence 5'-3' | SEQ ID NO: |
|---|---|---|---|---|---|
| 603 | 603-621 | AGCAGUCUUAUCUAACUAUTT | 696 | AUAGUUAGAUAAGACUGCUTT | 697 |
| 604 | 604-622 | GCAGUCUUAUCUAACUAUGTT | 698 | CAUAGUUAGAUAAGACUGCTT | 699 |
| 605 | 605-623 | CAGUCUUAUCUAACUAUGATT | 700 | UCAUAGUUAGAUAAGACUGTT | 701 |
| 608 | 608-626 | UCUUAUCUAACUAUGAUGCUTT | 702 | GCAUCAUAGUUAGAUAAGATT | 703 |
| 609 | 609-627 | CUUAUCUAACUAUGAUGCATT | 704 | UGCAUCAUAGUUAGAUAAGTT | 705 |
| 610 | 610-628 | UUAUCUAACUAUGAUGCAATT | 706 | UUGCAUCAUAGUUAGAUAATT | 707 |
| 611 | 611-629 | UAUCUAACUAUGAUGCAAUTT | 708 | UUUGCAUCAUAGUUAGAUATT | 709 |
| 612 | 612-630 | AUCUAACUAUGAUGCAAAUTT | 710 | AUUUGCAUCAUAGUUAGAUTT | 711 |
| 613 | 613-631 | UCUAACUAUGAUGCAAAUATT | 712 | UAUUUGCAUCAUAGUUAGATT | 713 |
| 614 | 614-632 | CUAACUAUGAUGCAAAUAUTT | 714 | UUAUUUGCAUCAUAGUUAGTT | 715 |
| 616 | 616-634 | AACUAUGAUGCAAAUAAAATT | 716 | UUUUAUUUGCAUCAUAGUUTT | 717 |
| 622 | 622-640 | GAUGCAAAUAAAACCGGACTT | 718 | GUCCGGUUUUAUUUGCAUCTT | 719 |
| 623 | 623-641 | AUGCAAAUAAAACCGGACUTT | 720 | AGUCCGGUUUUAUUUGCAUTT | 721 |
| 624 | 624-642 | UGCAAAUAAAACCGGACUGTT | 722 | CAGUCCGGUUUUAUUUGCATT | 723 |
| 626 | 626-644 | CAAAUAAAACCGGACUGAATT | 724 | UUCAGUCCGGUUUUAUUUGTT | 725 |
| 627 | 627-645 | AAAUAAAACCGGACUGAAGTT | 726 | CUUCAGUCCGGUUUUAUUUTT | 727 |
| 628 | 628-646 | AAUAAAACCGGACUGAAGGTT | 728 | CCUUCAGUCCGGUUUUAUUTT | 729 |
| 630 | 630-648 | UAAAACCGGACUGAAGGAGTT | 730 | CUCCUUCAGUCCGGUUUUATT | 731 |
| 631 | 631-649 | AAAACCGGACUGAAGGAGCTT | 732 | GCUCCUUCAGUCCGGUUUUTT | 733 |
| 632 | 632-650 | AAACCGGACUGAAGGAGCUTT | 734 | AGCUCCUUCAGUCCGGUUUTT | 735 |
| 633 | 633-651 | AACCGGACUGAAGGAGCUGTT | 736 | CAGCUCCUUCAGUCCGGUUTT | 737 |
| 644 | 644-662 | AGGAGCUGCCCAUGAGAAATT | 738 | UUUCUCAUGGGCAGCUCCUTT | 739 |
| 665 | 665-683 | UACAGGAAAUCCUGCAUGGTT | 740 | CCAUGCAGGAUUUCCUGUATT | 741 |
| 668 | 668-686 | AGGAAAUCCUGCAUGGCGCTT | 742 | GCGCCAUGCAGGAUUUCCUTT | 743 |

TABLE 5-continued

EGFR siRNA Sequences

| hs Id # | Sequence position in NM_005228.3 | sense strand sequence 5'-3' | SEQ ID NO: | antisense strand sequence 5'-3' | SEQ ID NO: |
|---|---|---|---|---|---|
| 669 | 669-687 | GGAAAUCCUGCAUGGCGCCTT | 744 | GGCGCCAUGCAGGAUUUCCTT | 745 |
| 670 | 670-688 | GAAAUCCUGCAUGGCGCCGTT | 746 | CGGCGCCAUGCAGGAUUUCTT | 747 |
| 671 | 671-689 | AAAUCCUGCAUGGCGCCGUTT | 748 | ACGGCGCCAUGCAGGAUUUTT | 749 |
| 672 | 672-690 | AAUCCUGCAUGGCGCCGUGTT | 750 | CACGGCGCCAUGCAGGAUUTT | 751 |
| 674 | 674-692 | UCCUGCAUGGCGCCGUGCGTT | 752 | CGCACGGCGCCAUGCAGGATT | 753 |
| 676 | 676-694 | CUGCAUGGCGCCGUGCGGUTT | 754 | ACCGCACGGCGCCAUGCAGTT | 755 |
| 677 | 677-695 | UGCAUGGCGCCGUGCGGUUTT | 756 | AACCGCACGGCGCCAUGCATT | 757 |
| 678 | 678-696 | GCAUGGCGCCGUGCGGUUCTT | 758 | GAACCGCACGGCGCCAUGCTT | 759 |
| 680 | 680-698 | AUGGCGCCGUGCGGUUCAGTT | 760 | CUGAACCGCACGGCGCCAUTT | 761 |
| 681 | 681-699 | UGGCGCCGUGCGGUUCAGCTT | 762 | GCUGAACCGCACGGCGCCATT | 763 |
| 682 | 682-700 | GGCGCCGUGCGGUUCAGCATT | 764 | UGCUGAACCGCACGGCGCCTT | 765 |
| 683 | 683-701 | GCGCCGUGCGGUUCAGCAATT | 766 | UUGCUGAACCGCACGGCGCTT | 767 |
| 684 | 684-702 | CGCCGUGCGGUUCAGCAACTT | 768 | GUUGCUGAACCGCACGGCGTT | 769 |
| 685 | 685-703 | GCCGUGCGGUUCAGCAACATT | 770 | UGUUGCUGAACCGCACGGCTT | 771 |
| 686 | 686-704 | CCGUGCGGUUCAGCAACAATT | 772 | UUGUUGCUGAACCGCACGGTT | 773 |
| 688 | 688-706 | GUGCGGUUCAGCAACAACCTT | 774 | GGUUGUUGCUGAACCGCACTT | 775 |
| 690 | 690-708 | GCGGUUCAGCAACAACCCUTT | 776 | AGGGUUGUUGCUGAACCGCTT | 777 |
| 692 | 692-710 | GGUUCAGCAACAACCCUGCTT | 778 | GCAGGGUUGUUGCUGAACCTT | 779 |
| 698 | 698-716 | GCAACAACCCUGCCCUGUGTT | 780 | CACAGGGCAGGGUUGUUGCTT | 781 |
| 700 | 700-718 | AACAACCCUGCCCUGUGCATT | 782 | UGCACAGGGCAGGGUUGUUTT | 783 |
| 719 | 719-737 | ACGUGGAGAGCAUCCAGUGTT | 784 | CACUGGAUGCUCUCCACGUTT | 785 |
| 720 | 720-738 | CGUGGAGAGCAUCCAGUGGTT | 786 | CCACUGGAUGCUCUCCACGTT | 787 |
| 721 | 721-739 | GUGGAGAGCAUCCAGUGGCTT | 788 | GCCACUGGAUGCUCUCCACTT | 789 |
| 724 | 724-742 | GAGAGCAUCCAGUGGCGGGTT | 790 | CCCGCCACUGGAUGCUCUCTT | 791 |

TABLE 5-continued

EGFR siRNA Sequences

| hs Id # | Sequence position in NM_005228.3 | sense strand sequence 5'-3' | SEQ ID NO: | antisense strand sequence 5'-3' | SEQ ID NO: |
|---|---|---|---|---|---|
| 725 | 725-743 | AGAGCAUCCAGUGGCGGGATT | 792 | UCCCGCCACUGGAUGCUCUTT | 793 |
| 726 | 726-744 | GAGCAUCCAGUGGCGGGACTT | 794 | GUCCCGCCACUGGAUGCUCTT | 795 |
| 733 | 733-751 | CAGUGGCGGGACAUAGUCATT | 796 | UGACUAUGUCCCGCCACUGTT | 797 |
| 734 | 734-752 | AGUGGCGGGACAUAGUCAGTT | 798 | CUGACUAUGUCCCGCCACUTT | 799 |
| 736 | 736-754 | UGGCGGGACAUAGUCAGCATT | 800 | UGCUGACUAUGUCCCGCCATT | 801 |
| 737 | 737-755 | GGCGGGACAUAGUCAGCAGTT | 802 | CUGCUGACUAUGUCCCGCCTT | 803 |
| 763 | 763-781 | CUCAGCAACAUGUCGAUGGTT | 804 | CCAUCGACAUGUUGCUGAGTT | 805 |
| 765 | 765-783 | CAGCAACAUGUCGAUGGACTT | 806 | GUCCAUCGACAUGUUGCUGTT | 807 |
| 766 | 766-784 | AGCAACAUGUCGAUGGACUTT | 808 | AGUCCAUCGACAUGUUGCUTT | 809 |
| 767 | 767-785 | GCAACAUGUCGAUGGACUUTT | 810 | AAGUCCAUCGACAUGUUGCTT | 811 |
| 769 | 769-787 | AACAUGUCGAUGGACUUCCTT | 812 | GGAAGUCCAUCGACAUGUUTT | 813 |
| 770 | 770-788 | ACAUGUCGAUGGACUUCCATT | 814 | UGGAAGUCCAUCGACAUGUTT | 815 |
| 771 | 771-789 | CAUGUCGAUGGACUUCCAGTT | 816 | CUGGAAGUCCAUCGACAUGTT | 817 |
| 772 | 772-790 | AUGUCGAUGGACUUCCAGATT | 818 | UCUGGAAGUCCAUCGACAUTT | 819 |
| 775 | 775-793 | UCGAUGGACUUCCAGAACCTT | 820 | GGUUCUGGAAGUCCAUCGATT | 821 |
| 789 | 789-807 | GAACCACCUGGGCAGCUGCTT | 822 | GCAGCUGCCCAGGUGGUUCTT | 823 |
| 798 | 798-816 | GGGCAGCUGCCAAAAGUGUTT | 824 | ACACUUUUGGCAGCUGCCCTT | 825 |
| 800 | 800-818 | GCAGCUGCCAAAAGUGUGATT | 826 | UCACACUUUUGGCAGCUGCTT | 827 |
| 805 | 805-823 | UGCCAAAAGUGUGAUCCAATT | 828 | UUGGAUCACACUUUUGGCATT | 829 |
| 806 | 806-824 | GCCAAAAGUGUGAUCCAAGTT | 830 | CUUGGAUCACACUUUUGGCTT | 831 |
| 807 | 807-825 | CCAAAAGUGUGAUCCAAGCTT | 832 | GCUUGGAUCACACUUUUGGTT | 833 |
| 810 | 810-828 | AAAGUGUGAUCCAAGCUGUTT | 834 | ACAGCUUGGAUCACACUUUTT | 835 |
| 814 | 814-832 | UGUGAUCCAAGCUGUCCCATT | 836 | UGGGACAGCUUGGAUCACATT | 837 |
| 815 | 815-833 | GUGAUCCAAGCUGUCCCAATT | 838 | UUGGGACAGCUUGGAUCACTT | 839 |

TABLE 5-continued

EGFR siRNA Sequences

| hs Id # | Sequence position in NM_005228.3 | sense strand sequence 5'-3' | SEQ ID NO: | antisense strand sequence 5'-3' | SEQ ID NO: |
|---|---|---|---|---|---|
| 817 | 817-835 | GAUCCAAGCUGUCCCAAUGTT | 840 | CAUUGGGACAGCUUGGAUCTT | 841 |
| 818 | 818-836 | AUCCAAGCUGUCCCAAUGGTT | 842 | CCAUUGGGACAGCUUGGAUTT | 843 |
| 819 | 819-837 | UCCAAGCUGUCCCAAUGGGTT | 844 | CCCAUUGGGACAGCUUGGATT | 845 |
| 820 | 820-838 | CCAAGCUGUCCCAAUGGGATT | 846 | UCCCAUUGGGACAGCUUGGTT | 847 |
| 821 | 821-839 | CAAGCUGUCCCAAUGGGAGTT | 848 | CUCCCAUUGGGACAGCUUGTT | 849 |
| 823 | 823-841 | AGCUGUCCCAAUGGGAGCUTT | 850 | AGCUCCCAUUGGGACAGCUTT | 851 |
| 826 | 826-844 | UGUCCCAAUGGGAGCUGCUTT | 852 | AGCAGCUCCCAUUGGGACATT | 853 |
| 847 | 847-865 | GGUGCAGGAGAGGAGAACUTT | 854 | AGUUCUCCUCUCCUGCACCTT | 855 |
| 871 | 871-889 | AAACUGACCAAAAUCAUCUTT | 856 | AGAUGAUUUUGGUCAGUUUTT | 857 |
| 872 | 872-890 | AACUGACCAAAAUCAUCUGTT | 858 | CAGAUGAUUUUGGUCAGUUTT | 859 |
| 873 | 873-891 | ACUGACCAAAAUCAUCUGUTT | 860 | ACAGAUGAUUUUGGUCAGUTT | 861 |
| 877 | 877-895 | ACCAAAAUCAUCUGUGCCCTT | 862 | GGGCACAGAUGAUUUUGGUTT | 863 |
| 878 | 878-896 | CCAAAAUCAUCUGUGCCCATT | 864 | UGGGCACAGAUGAUUUUGGTT | 865 |
| 881 | 881-899 | AAAUCAUCUGUGCCCAGCATT | 866 | UGCUGGGCACAGAUGAUUUTT | 867 |
| 890 | 890-908 | GUGCCCAGCAGUGCUCCGGTT | 868 | CCGGAGCACUGCUGGGCACTT | 869 |
| 892 | 892-910 | GCCCAGCAGUGCUCCGGGCTT | 870 | GCCCGGAGCACUGCUGGGCTT | 871 |
| 929 | 929-947 | CCAGUGACUGCUGCCACAATT | 872 | UUGUGGCAGCAGUCACUGGTT | 873 |
| 930 | 930-948 | CAGUGACUGCUGCCACAACTT | 874 | GUUGUGGCAGCAGUCACUGTT | 875 |
| 979 | 979-997 | GAGAGCGACUGCCUGGUCUTT | 876 | AGACCAGGCAGUCGCUCUCTT | 877 |
| 980 | 980-998 | AGAGCGACUGCCUGGUCUGTT | 878 | CAGACCAGGCAGUCGCUCUTT | 879 |
| 981 | 981-999 | GAGCGACUGCCUGGUCUGCTT | 880 | GCAGACCAGGCAGUCGCUCTT | 881 |
| 982 | 982-1000 | AGCGACUGCCUGGUCUGCCTT | 882 | GGCAGACCAGGCAGUCGCUTT | 883 |
| 983 | 983-1001 | GCGACUGCCUGGUCUGCCGTT | 884 | CGGCAGACCAGGCAGUCGCTT | 885 |
| 984 | 984-1002 | CGACUGCCUGGUCUGCCGCTT | 886 | GCGGCAGACCAGGCAGUCGTT | 887 |

TABLE 5-continued

EGFR siRNA Sequences

| hs Id # | Sequence position in NM_005228.3 | sense strand sequence 5'-3' | SEQ ID NO: | antisense strand sequence 5'-3' | SEQ ID NO: |
|---|---|---|---|---|---|
| 989 | 989-1007 | GCCUGGUCUGCCGCAAAUUTT | 888 | AAUUUGCGGCAGACCAGGCTT | 889 |
| 990 | 990-1008 | CCUGGUCUGCCGCAAAUUCTT | 890 | GAAUUUGCGGCAGACCAGGTT | 891 |
| 991 | 991-1009 | CUGGUCUGCCGCAAAUUCCTT | 892 | GGAAUUUGCGGCAGACCAGTT | 893 |
| 992 | 992-1010 | UGGUCUGCCGCAAAUUCCGTT | 894 | CGGAAUUUGCGGCAGACCATT | 895 |
| 994 | 994-1012 | GUCUGCCGCAAAUUCCGAGTT | 896 | CUCGGAAUUUGCGGCAGACTT | 897 |
| 995 | 995-1013 | UCUGCCGCAAAUUCCGAGATT | 898 | UCUCGGAAUUUGCGGCAGATT | 899 |
| 996 | 996-1014 | CUGCCGCAAAUUCCGAGACTT | 900 | GUCUCGGAAUUUGCGGCAGTT | 901 |
| 997 | 997-1015 | UGCCGCAAAUUCCGAGACGTT | 902 | CGUCUCGGAAUUUGCGGCATT | 903 |
| 999 | 999-1017 | CCGCAAAUUCCGAGACGAATT | 904 | UUCGUCUCGGAAUUUGCGGTT | 905 |
| 1004 | 1004-1022 | AAUUCCGAGACGAAGCCACTT | 906 | GUGGCUUCGUCUCGGAAUUTT | 907 |
| 1005 | 1005-1023 | AUUCCGAGACGAAGCCACGTT | 908 | CGUGGCUUCGUCUCGGAAUTT | 909 |
| 1006 | 1006-1024 | UUCCGAGACGAAGCCACGUTT | 910 | ACGUGGCUUCGUCUCGGAATT | 911 |
| 1007 | 1007-1025 | UCCGAGACGAAGCCACGUGTT | 912 | CACGUGGCUUCGUCUCGGATT | 913 |
| 1008 | 1008-1026 | CCGAGACGAAGCCACGUGCTT | 914 | GCACGUGGCUUCGUCUCGGTT | 915 |
| 1010 | 1010-1028 | GAGACGAAGCCACGUGCAATT | 916 | UUGCACGUGGCUUCGUCUCTT | 917 |
| 1013 | 1013-1031 | ACGAAGCCACGUGCAAGGATT | 918 | UCCUUGCACGUGGCUUCGUTT | 919 |
| 1014 | 1014-1032 | CGAAGCCACGUGCAAGGACTT | 920 | GUCCUUGCACGUGGCUUCGTT | 921 |
| 1015 | 1015-1033 | GAAGCCACGUGCAAGGACATT | 922 | UGUCCUUGCACGUGGCUUCTT | 923 |
| 1016 | 1016-1034 | AAGCCACGUGCAAGGACACTT | 924 | GUGUCCUUGCACGUGGCUUTT | 925 |
| 1040 | 1040-1058 | CCCCACUCAUGCUCUACAATT | 926 | UUGUAGAGCAUGAGUGGGGTT | 927 |
| 1042 | 1042-1060 | CCACUCAUGCUCUACAACCTT | 928 | GGUUGUAGAGCAUGAGUGGTT | 929 |
| 1044 | 1044-1062 | ACUCAUGCUCUACAACCCCTT | 930 | GGGGUUGUAGAGCAUGAGUTT | 931 |
| 1047 | 1047-1065 | CAUGCUCUACAACCCCACCTT | 932 | GGUGGGGUUGUAGAGCAUGTT | 933 |
| 1071 | 1071-1089 | CCAGAUGGAUGUGAACCCCTT | 934 | GGGGUUCACAUCCAUCUGGTT | 935 |

TABLE 5-continued

EGFR siRNA Sequences

| hs Id # | Sequence position in NM_005228.3 | sense strand sequence 5'-3' | SEQ ID NO: | antisense strand sequence 5'-3' | SEQ ID NO: |
|---|---|---|---|---|---|
| 1073 | 1073-1091 | AGAUGGAUGUGAACCCCGATT | 936 | UCGGGGUUCACAUCCAUCUTT | 937 |
| 1074 | 1074-1092 | GAUGGAUGUGAACCCCGAGTT | 938 | CUCGGGGUUCACAUCCAUCTT | 939 |
| 1075 | 1075-1093 | AUGGAUGUGAACCCCGAGGTT | 940 | CCUCGGGGUUCACAUCCAUTT | 941 |
| 1077 | 1077-1095 | GGAUGUGAACCCCGAGGGCTT | 942 | GCCCUCGGGGUUCACAUCCTT | 943 |
| 1078 | 1078-1096 | GAUGUGAACCCCGAGGGCATT | 944 | UGCCCUCGGGGUUCACAUCTT | 945 |
| 1080 | 1080-1098 | UGUGAACCCCGAGGGCAAATT | 946 | UUUGCCCUCGGGGUUCACATT | 947 |
| 1084 | 1084-1102 | AACCCCGAGGGCAAAUACATT | 948 | UGUAUUUGCCCUCGGGGUUTT | 949 |
| 1085 | 1085-1103 | ACCCCGAGGGCAAAUACAGTT | 950 | CUGUAUUUGCCCUCGGGGUTT | 951 |
| 1087 | 1087-1105 | CCCGAGGGCAAAUACAGCUTT | 952 | AGCUGUAUUUGCCCUCGGGTT | 953 |
| 1088 | 1088-1106 | CCGAGGGCAAAUACAGCUUTT | 954 | AAGCUGUAUUUGCCCUCGGTT | 955 |
| 1089 | 1089-1107 | CGAGGGCAAAUACAGCUUUTT | 956 | AAAGCUGUAUUUGCCCUCGTT | 957 |
| 1096 | 1096-1114 | AAAUACAGCUUUGGUGCCATT | 958 | UGGCACCAAAGCUGUAUUUTT | 959 |
| 1097 | 1097-1115 | AAUACAGCUUUGGUGCCACTT | 960 | GUGGCACCAAAGCUGUAUUTT | 961 |
| 1098 | 1098-1116 | AUACAGCUUUGGUGCCACCTT | 962 | GGUGGCACCAAAGCUGUAUTT | 963 |
| 1104 | 1104-1122 | CUUUGGUGCCACCUGCGUGTT | 964 | CACGCAGGUGGCACCAAAGTT | 965 |
| 1106 | 1106-1124 | UUGGUGCCACCUGCGUGAATT | 966 | UUCACGCAGGUGGCACCAATT | 967 |
| 1112 | 1112-1130 | CCACCUGCGUGAAGAAGUGTT | 968 | CACUUCUUCACGCAGGUGGTT | 969 |
| 1116 | 1116-1134 | CUGCGUGAAGAAGUGUCCCTT | 970 | GGGACACUUCUUCACGCAGTT | 971 |
| 1117 | 1117-1135 | UGCGUGAAGAAGUGUCCCCTT | 972 | GGGGACACUUCUUCACGCATT | 973 |
| 1118 | 1118-1136 | GCGUGAAGAAGUGUCCCCGTT | 974 | CGGGGACACUUCUUCACGCTT | 975 |
| 1119 | 1119-1137 | CGUGAAGAAGUGUCCCCGUTT | 976 | ACGGGGACACUUCUUCACGTT | 977 |
| 1120 | 1120-1138 | GUGAAGAAGUGUCCCCGUATT | 978 | UACGGGGACACUUCUUCACTT | 979 |
| 1121 | 1121-1139 | UGAAGAAGUGUCCCCGUAATT | 980 | UUACGGGGACACUUCUUCATT | 981 |
| 1122 | 1122-1140 | GAAGAAGUGUCCCCGUAAUTT | 982 | AUUACGGGGACACUUCUUCTT | 983 |

TABLE 5-continued

EGFR siRNA Sequences

| hs Id # | Sequence position in NM_005228.3 | sense strand sequence 5'-3' | SEQ ID NO: | antisense strand sequence 5'-3' | SEQ ID NO: |
|---|---|---|---|---|---|
| 1123 | 1123-1141 | AAGAAGUGUCCCCGUAAUUTT | 984 | AAUUACGGGGACACUUCUUTT | 985 |
| 1124 | 1124-1142 | AGAAGUGUCCCCGUAAUUATT | 986 | UAAUUACGGGGACACUUCUTT | 987 |
| 1125 | 1125-1143 | GAAGUGUCCCCGUAAUUAUTT | 988 | AUAAUUACGGGGACACUUCTT | 989 |
| 1126 | 1126-1144 | AAGUGUCCCCGUAAUUAUGTT | 990 | CAUAAUUACGGGGACACUUTT | 991 |
| 1127 | 1127-1145 | AGUGUCCCCGUAAUUAUGUTT | 992 | ACAUAAUUACGGGGACACUTT | 993 |
| 1128 | 1128-1146 | GUGUCCCCGUAAUUAUGUGTT | 994 | CACAUAAUUACGGGGACACTT | 995 |
| 1129 | 1129-1147 | UGUCCCCGUAAUUAUGUGGTT | 996 | CCACAUAAUUACGGGGACATT | 997 |
| 1130 | 1130-1148 | GUCCCCGUAAUUAUGUGGTT | 998 | ACCACAUAAUUACGGGGACTT | 999 |
| 1132 | 1132-1150 | CCCCGUAAUUAUGUGGUGATT | 1000 | UCACCACAUAAUUACGGGGTT | 1001 |
| 1134 | 1134-1152 | CCGUAAUUAUGUGGUGACATT | 1002 | UGUCACCACAUAAUUACGGTT | 1003 |
| 1136 | 1136-1154 | GUAAUUAUGUGGUGACAGATT | 1004 | UCUGUCACCACAUAAUUACTT | 1005 |
| 1137 | 1137-1155 | UAAUUAUGUGGUGACAGAUTT | 1006 | AUCUGUCACCACAUAAUUATT | 1007 |
| 1138 | 1138-1156 | AAUUAUGUGGUGACAGAUCTT | 1008 | GAUCUGUCACCACAUAAUUTT | 1009 |
| 1139 | 1139-1157 | AUUAUGUGGUGACAGAUCATT | 1010 | UGAUCUGUCACCACAUAAUTT | 1011 |
| 1140 | 1140-1158 | UUAUGUGGUGACAGAUCACTT | 1012 | GUGAUCUGUCACCACAUAATT | 1013 |
| 1142 | 1142-1160 | AUGUGGUGACAGAUCACGGTT | 1014 | CCGUGAUCUGUCACCACAUTT | 1015 |
| 1145 | 1145-1163 | UGGUGACAGAUCACGGCUCTT | 1016 | GAGCCGUGAUCUGUCACCATT | 1017 |
| 1147 | 1147-1165 | GUGACAGAUCACGGCUCGUTT | 1018 | ACGAGCCGUGAUCUGUCACTT | 1019 |
| 1148 | 1148-1166 | UGACAGAUCACGGCUCGUGTT | 1020 | CACGAGCCGUGAUCUGUCATT | 1021 |
| 1149 | 1149-1167 | GACAGAUCACGGCUCGUGCTT | 1022 | GCACGAGCCGUGAUCUGUCTT | 1023 |
| 1150 | 1150-1168 | ACAGAUCACGGCUCGUGCGTT | 1024 | CGCACGAGCCGUGAUCUGUTT | 1025 |
| 1151 | 1151-1169 | CAGAUCACGGCUCGUGCGUTT | 1026 | ACGCACGAGCCGUGAUCUGTT | 1027 |
| 1152 | 1152-1170 | AGAUCACGGCUCGUGCGUCTT | 1028 | GACGCACGAGCCGUGAUCUTT | 1029 |
| 1153 | 1153-1171 | GAUCACGGCUCGUGCGUCCTT | 1030 | GGACGCACGAGCCGUGAUCTT | 1031 |

TABLE 5-continued

EGFR siRNA Sequences

| hs Id # | Sequence position in NM_005228.3 | sense strand sequence 5'-3' | SEQ ID NO: | antisense strand sequence 5'-3' | SEQ ID NO: |
|---|---|---|---|---|---|
| 1154 | 1154-1172 | AUCACGGCUCGUGCGUCCGTT | 1032 | CGGACGCACGAGCCGUGAUTT | 1033 |
| 1155 | 1155-1173 | UCACGGCUCGUGCGUCCGATT | 1034 | UCGGACGCACGAGCCGUGATT | 1035 |
| 1156 | 1156-1174 | CACGGCUCGUGCGUCCGAGTT | 1036 | CUCGGACGCACGAGCCGUGTT | 1037 |
| 1157 | 1157-1175 | ACGGCUCGUGCGUCCGAGCTT | 1038 | GCUCGGACGCACGAGCCGUTT | 1039 |
| 1160 | 1160-1178 | GCUCGUGCGUCCGAGCUGTT | 1040 | CAGGCUCGGACGCACGAGCTT | 1041 |
| 1200 | 1200-1218 | GGAGGAAGACGGCGUCCGCTT | 1042 | GCGGACGCCGUCUUCCUCCTT | 1043 |
| 1201 | 1201-1219 | GAGGAAGACGGCGUCCGCATT | 1044 | UGCGGACGCCGUCUUCCUCTT | 1045 |
| 1203 | 1203-1221 | GGAAGACGGCGUCCGCAAGTT | 1046 | CUUGCGGACGCCGUCUUCCTT | 1047 |
| 1204 | 1204-1222 | GAAGACGGCGUCCGCAAGUTT | 1048 | ACUUGCGGACGCCGUCUUCTT | 1049 |
| 1205 | 1205-1223 | AAGACGGCGUCCGCAAGUGTT | 1050 | CACUUGCGGACGCCGUCUUTT | 1051 |
| 1207 | 1207-1225 | GACGGCGUCCGCAAGUGUATT | 1052 | UACACUUGCGGACGCCGUCTT | 1053 |
| 1208 | 1208-1226 | ACGGCGUCCGCAAGUGUAATT | 1054 | UUACACUUGCGGACGCCGUTT | 1055 |
| 1211 | 1211-1229 | GCGUCCGCAAGUGUAAGAATT | 1056 | UUCUUACACUUGCGGACGCTT | 1057 |
| 1212 | 1212-1230 | CGUCCGCAAGUGUAAGAAGTT | 1058 | CUUCUUACACUUGCGGACGTT | 1059 |
| 1213 | 1213-1231 | GUCCGCAAGUGUAAGAAGUTT | 1060 | ACUUCUUACACUUGCGGACTT | 1061 |
| 1214 | 1214-1232 | UCCGCAAGUGUAAGAAGUGTT | 1062 | CACUUCUUACACUUGCGGATT | 1063 |
| 1215 | 1215-1233 | CCGCAAGUGUAAGAAGUGCTT | 1064 | GCACUUCUUACACUUGCGGTT | 1065 |
| 1216 | 1216-1234 | CGCAAGUGUAAGAAGUGCGTT | 1066 | CGCACUUCUUACACUUGCGTT | 1067 |
| 1217 | 1217-1235 | GCAAGUGUAAGAAGUGCGATT | 1068 | UCGCACUUCUUACACUUGCTT | 1069 |
| 1219 | 1219-1237 | AAGUGUAAGAAGUGCGAAGTT | 1070 | CUUCGCACUUCUUACACUUTT | 1071 |
| 1220 | 1220-1238 | AGUGUAAGAAGUGCGAAGGTT | 1072 | CCUUCGCACUUCUUACACUTT | 1073 |
| 1221 | 1221-1239 | GUGUAAGAAGUGCGAAGGGTT | 1074 | CCCUUCGCACUUCUUACACTT | 1075 |
| 1222 | 1222-1240 | UGUAAGAAGUGCGAAGGCTT | 1076 | GCCCUUCGCACUUCUUACATT | 1077 |
| 1223 | 1223-1241 | GUAAGAAGUGCGAAGGCCTT | 1078 | GGCCCUUCGCACUUCUUACTT | 1079 |

TABLE 5-continued

EGFR siRNA Sequences

| hs Id # | Sequence position in NM_005228.3 | sense strand sequence 5'-3' | SEQ ID NO: | antisense strand sequence 5'-3' | SEQ ID NO: |
|---|---|---|---|---|---|
| 1224 | 1224-1242 | UAAGAAGUGCGAAGGGCCUTT | 1080 | AGGCCCUUCGCACUUCUUAUT | 1081 |
| 1225 | 1225-1243 | AAGAAGUGCGAAGGGCCUUTT | 1082 | AAGGCCCUUCGCACUUCUUTT | 1083 |
| 1226 | 1226-1244 | AGAAGUGCGAAGGGCCUUGTT | 1084 | CAAGGCCCUUCGCACUUCUTT | 1085 |
| 1229 | 1229-1247 | AGUGCGAAGGGCCUUGCCGTT | 1086 | CGGCAAGGCCCUUCGCACUTT | 1087 |
| 1230 | 1230-1248 | GUGCGAAGGGCCUUGCCGCTT | 1088 | GCGGCAAGGCCCUUCGCACTT | 1089 |
| 1231 | 1231-1249 | UGCGAAGGGCCUUGCCGCATT | 1090 | UGCGGCAAGGCCCUUCGCATT | 1091 |
| 1232 | 1232-1250 | GCGAAGGGCCUUGCCGCAATT | 1092 | UUGCGGCAAGGCCCUUCGCTT | 1093 |
| 1233 | 1233-1251 | CGAAGGGCCUUGCCGCAAATT | 1094 | UUUGCGGCAAGGCCCUUCGTT | 1095 |
| 1235 | 1235-1253 | AAGGGCCUUGCCGCAAAGUTT | 1096 | ACUUUGCGGCAAGGCCCUUTT | 1097 |
| 1236 | 1236-1254 | AGGGCCUUGCCGCAAAGUGTT | 1098 | CACUUUGCGGCAAGGCCCUTT | 1099 |
| 1237 | 1237-1255 | GGGCCUUGCCGCAAAGUGUTT | 1100 | ACACUUUGCGGCAAGGCCCTT | 1101 |
| 1238 | 1238-1256 | GGCCUUGCCGCAAAGUGUGTT | 1102 | CACACUUUGCGGCAAGGCCTT | 1103 |
| 1239 | 1239-1257 | GCCUUGCCGCAAAGUGUGUTT | 1104 | ACACACUUUGCGGCAAGGCTT | 1105 |
| 1241 | 1241-1259 | CUUGCCGCAAAGUGUGUAATT | 1106 | UUACACACUUUGCGGCAAGTT | 1107 |
| 1261 | 1261-1279 | GGAAUAGGUAUUGGUGAAUTT | 1108 | AUUCACCAAUACCUAUUCCTT | 1109 |
| 1262 | 1262-1280 | GAAUAGGUAUUGGUGAAUUTT | 1110 | AAUUCACCAAUACCUAUUCTT | 1111 |
| 1263 | 1263-1281 | AAUAGGUAUUGGUGAAUUUTT | 1112 | AAAUUCACCAAUACCUAUUTT | 1113 |
| 1264 | 1264-1282 | AUAGGUAUUGGUGAAUUUATT | 1114 | UAAAUUCACCAAUACCUAUTT | 1115 |
| 1266 | 1266-1284 | AGGUAUUGGUGAAUUUAAATT | 1116 | UUUAAAUUCACCAAUACCUTT | 1117 |
| 1267 | 1267-1285 | GGUAUUGGUGAAUUUAAAGTT | 1118 | CUUUAAAUUCACCAAUACCTT | 1119 |
| 1289 | 1289-1307 | CACUCUCCAUAAAUGCUACTT | 1120 | GUAGCAUUUAUGGAGAGUGTT | 1121 |
| 1313 | 1313-1331 | UUAAACACUUCAAAAACUGTT | 1122 | CAGUUUUUGAAGUGUUUAATT | 1123 |
| 1320 | 1320-1338 | CUUCAAAAACUGCACCUCCTT | 1124 | GGAGGUGCAGUUUUUGAAGTT | 1125 |
| 1321 | 1321-1339 | UUCAAAAACUGCACCUCCATT | 1126 | UGGAGGUGCAGUUUUUGAATT | 1127 |

TABLE 5-continued

EGFR siRNA Sequences

| hs Id # | Sequence position in NM_005228.3 | sense strand sequence 5'-3' | SEQ ID NO: | antisense strand sequence 5'-3' | SEQ ID NO: |
|---|---|---|---|---|---|
| 1322 | 1322-1340 | UCAAAAACUGCACCUCCAUTT | 1128 | AUGGAGGUGCAGUUUUUGATT | 1129 |
| 1323 | 1323-1341 | CAAAAACUGCACCUCCAUCTT | 1130 | GAUGGAGGUGCAGUUUUUGTT | 1131 |
| 1324 | 1324-1342 | AAAAACUGCACCUCCAUCATT | 1132 | UGAUGGAGGUGCAGUUUUUTT | 1133 |
| 1328 | 1328-1346 | ACUGCACCUCCAUCAGUGGTT | 1134 | CCACUGAUGGAGGUGCAGUTT | 1135 |
| 1332 | 1332-1350 | CACCUCCAUCAGUGGCGAUTT | 1136 | AUCGCCACUGAUGGAGGUGTT | 1137 |
| 1333 | 1333-1351 | ACCUCCAUCAGUGGCGAUCTT | 1138 | GAUCGCCACUGAUGGAGGUGTT | 1139 |
| 1335 | 1335-1353 | CUCCAUCAGUGGCGAUCUCTT | 1140 | GAGAUCGCCACUGAUGGAGTT | 1141 |
| 1338 | 1338-1356 | CAUCAGUGGCGAUCUCCACTT | 1142 | GUGGAGAUCGCCACUGAUGTT | 1143 |
| 1344 | 1344-1362 | UGGCGAUCUCCACAUCCUGTT | 1144 | CAGGAUGUGGAGAUCGCCATT | 1145 |
| 1345 | 1345-1363 | GGCGAUCUCCACAUCCUGCTT | 1146 | GCAGGAUGUGGAGAUCGCCTT | 1147 |
| 1346 | 1346-1364 | GCGAUCUCCACAUCCUGCCTT | 1148 | GGCAGGAUGUGGAGAUCGCTT | 1149 |
| 1347 | 1347-1365 | CGAUCUCCACAUCCUGCCGTT | 1150 | CGGCAGGAUGUGGAGAUCGTT | 1151 |
| 1348 | 1348-1366 | GAUCUCCACAUCCUGCCGGTT | 1152 | CCGGCAGGAUGUGGAGAUCTT | 1153 |
| 1353 | 1353-1371 | CCACAUCCUGCCGGUGGCATT | 1154 | UGCCACCGGCAGGAUGUGGTT | 1155 |
| 1354 | 1354-1372 | CACAUCCUGCCGGUGGCAUTT | 1156 | AUGCCACCGGCAGGAUGUGTT | 1157 |
| 1355 | 1355-1373 | ACAUCCUGCCGGUGGCAUUTT | 1158 | AAUGCCACCGGCAGGAUGUTT | 1159 |
| 1357 | 1357-1375 | AUCCUGCCGGUGGCAUUUATT | 1160 | UAAAUGCCACCGGCAGGAUTT | 1161 |
| 1360 | 1360-1378 | CUGCCGGUGGCAUUUAGGGTT | 1162 | CCCUAAAUGCCACCGGCAGTT | 1163 |
| 1361 | 1361-1379 | UGCCGGUGGCAUUUAGGGGTT | 1164 | CCCCUAAAUGCCACCGGCATT | 1165 |
| 1362 | 1362-1380 | GCCGGUGGCAUUUAGGGGUTT | 1166 | ACCCCUAAAUGCCACCGGCTT | 1167 |
| 1363 | 1363-1381 | CCGGUGGCAUUUAGGGGUGTT | 1168 | CACCCCUAAAUGCCACCGGTT | 1169 |
| 1366 | 1366-1384 | GUGGCAUUUAGGGGUGACUTT | 1170 | AGUCACCCCUAAAUGCCACTT | 1171 |
| 1369 | 1369-1387 | GCAUUUAGGGGUGACUCCTT | 1172 | AGGAGUCACCCCUAAAUGCTT | 1173 |
| 1370 | 1370-1388 | CAUUUAGGGGUGACUCCUUTT | 1174 | AAGGAGUCACCCCUAAAUGTT | 1175 |

TABLE 5-continued

EGFR siRNA Sequences

| hs Id # | Sequence position in NM_005228.3 | sense strand sequence 5'-3' | SEQ ID NO: | antisense strand sequence 5'-3' | SEQ ID NO: |
|---|---|---|---|---|---|
| 1371 | 1371-1389 | AUUUAGGGGUGACUCCUUCTT | 1176 | GAAGGAGUCACCCCUAAAUTT | 1177 |
| 1372 | 1372-1390 | UUUAGGGGUGACUCCUUCATT | 1178 | UGAAGGAGUCACCCCUAAATT | 1179 |
| 1373 | 1373-1391 | UUAGGGGUGACUCCUUCACTT | 1180 | GUGAAGGAGUCACCCCUAATT | 1181 |
| 1374 | 1374-1392 | UAGGGGUGACUCCUUCACATT | 1182 | UGUGAAGGAGUCACCCCUATT | 1183 |
| 1404 | 1404-1422 | UCUGGAUCCACAGGAACUGTT | 1184 | CAGUUCCUGUGGAUCCAGATT | 1185 |
| 1408 | 1408-1426 | GAUCCACAGGAACUGGAUATT | 1186 | UAUCCAGUUCCUGUGGAUCTT | 1187 |
| 1409 | 1409-1427 | AUCCACAGGAACUGGAUAUTT | 1188 | AUAUCCAGUUCCUGUGGAUTT | 1189 |
| 1411 | 1411-1429 | CCACAGGAACUGGAUAUUCTT | 1190 | GAAUAUCCAGUUCCUGUGGTT | 1191 |
| 1412 | 1412-1430 | CACAGGAACUGGAUAUUCUTT | 1192 | AGAAUAUCCAGUUCCUGUGTT | 1193 |
| 1419 | 1419-1437 | ACUGGAUAUUCUGAAAACCTT | 1194 | GGUUUUCAGAAUAUCCAGUTT | 1195 |
| 1426 | 1426-1444 | AUUCUGAAAACCGUAAAGGTT | 1196 | CCUUUACGGUUUUCAGAAUTT | 1197 |
| 1427 | 1427-1445 | UUCUGAAAACCGUAAAGGATT | 1198 | UCCUUUACGGUUUUCAGAATT | 1199 |
| 1430 | 1430-1448 | UGAAAACCGUAAAGGAAAUTT | 1200 | AUUUCCUUUACGGUUUUCATT | 1201 |
| 1431 | 1431-1449 | GAAAACCGUAAAGGAAAUCTT | 1202 | GAUUUCCUUUACGGUUUUCTT | 1203 |

TABLE 6

EGFR siRNA Sequences with Chemical Modifications

| hs Id # | Sequence position in NM_005228.3 | sense strand sequence (5'-3') | SEQ ID NO: | antisense strand sequence (5'-3') | SEQ ID NO: |
|---|---|---|---|---|---|
| 68 | 68-86 | cgGfcCfgGfaGfuCfcCfgAfgCfuAfdTsdT | 1204 | UfAfgCfuCfgGfgAfcUfcCfgGfcCfgdTsdT | 1205 |
| 71 | 71-89 | ccGfgAfgUfcCfcGfaGfcUfaGfcCfdTsdT | 1206 | GfGfcUfaGfcUfcGfgGfaCfucGfgdTsdT | 1207 |
| 72 | 72-90 | cgGfaGfuCfcCfgAfgCfuAfgCfcCfdTsdT | 1208 | GfGfcUfaGfcUfcGfgGfaCfucCfgdTsdT | 1209 |
| 73 | 73-91 | ggAfgUfcCfcGfaGfcUfaGfcCfcCfdTsdT | 1210 | GfGfgCfuAfgCfuCfgGfgAfcUfcdTsdT | 1211 |
| 74 | 74-92 | gaGfuCfcCfgAfgCfuAfgCfcCfcGfdTsdT | 1212 | CfGfgGfcUfaGfcUfcGfgGfaCfudTsdT | 1213 |
| 75 | 75-93 | agUfcCfcGfaGfcUfaGfcCfcCfgGfdTsdT | 1214 | CfCfgGfgCfuAfgCfuCfgGfgAfcudTsdT | 1215 |
| 76 | 76-94 | guCfcCfgAfgCfuAfgCfcCfcGfgCfdTsdT | 1216 | GfCfcGfgGfcUfaGfcUfcGfgGfaCfdTsdT | 1217 |

TABLE 6-continued

EGFR siRNA Sequences with Chemical Modifications

| hs Id # | Sequence position in NM_005228.3 | sense strand sequence (5'-3') | SEQ ID NO: | antisense strand sequence (5'-3') | SEQ ID NO: |
|---|---|---|---|---|---|
| 78 | 78-96 | ccCfgAfgCfuAfgCfcCfcGfg CfgGfdTsdT | 1218 | CfCfgCfcGfgGfgCfuAfgCfuCf gGfgdTsdT | 1219 |
| 114 | 114-132 | ggAfcGfaCfaGfgCfcAfcCfu CfgUfdTsdT | 1220 | AfCfgAfgGfuGfgCfcUfgUfcGf uCfcdTsdT | 1221 |
| 115 | 115-133 | gaCfgAfcAfgGfcCfaCfcUfc GfuCfdTsdT | 1222 | GfAfcGfaGfgUfgGfcCfuGfuCf gUfcdTsdT | 1223 |
| 116 | 116-134 | acGfaCfaGfgCfcAfcCfuCfgU fcGfdTsdT | 1224 | CfGfaCfgAfgGfuGfgCfcUfgUf cGfudTsdT | 1225 |
| 117 | 117-135 | cgAfcAfgGfcCfaCfcUfcGfu CfgGfdTsdT | 1226 | CfCfgAfcGfaGfgUfgGfcCfuGf uCfgdTsdT | 1227 |
| 118 | 118-136 | gaCfaGfgCfcAfcCfuCfgUfc GfgCfdTsdT | 1228 | GfCfcGfaCfgAfgGfuGfgCfcUf gUfcdTsdT | 1229 |
| 120 | 120-138 | caGfgCfcAfcCfuCfgUfcGfg CfgUfdTsdT | 1230 | AfCfgCfcGfaCfgAfgGfuGfgCf cUfgdTsdT | 1231 |
| 121 | 121-139 | agGfcCfaCfcUfcGfuCfgGfc GfuCfdTsdT | 1232 | GfAfcGfcCfgAfcGfaGfgUfgGf cCfudTsdT | 1233 |
| 122 | 122-140 | ggCfcAfcCfuCfgUfcGfgCfg UfcCfdTsdT | 1234 | GfGfaCfgCfcGfaCfgAfgGfuGf gCfcdTsdT | 1235 |
| 123 | 123-141 | gcCfaCfcUfcGfuCfgGfcGfu CfcGfdTsdT | 1236 | CfGfgAfcGfcCfgAfcGfaGfgUf gGfcdTsdT | 1237 |
| 124 | 124-142 | ccAfcCfuCfgUfcGfgCfgUfc CfgCfdTsdT | 1238 | GfCfgGfaCfgCfcGfaCfgAfgGf uGfgdTsdT | 1239 |
| 125 | 125-143 | caCfcUfcGfuCfgGfcGfuCfc GfcCfdTsdT | 1240 | GfGfcGfgAfcGfcCfgAfcGfaGf gUfgdTsdT | 1241 |
| 126 | 126-144 | acCfuCfgUfcGfgCfgUfcCfg CfcCfdTsdT | 1242 | GfGfgCfgGfaCfgCfcGfaCfgAf gGfudTsdT | 1243 |
| 127 | 127-145 | ccUfcGfuCfgGfcGfuCfcGfc CfcGfdTsdT | 1244 | CfGfgGfcGfgAfcGfcCfgAfcGf aGfgdTsdT | 1245 |
| 128 | 128-146 | cuCfgUfcGfgCfgUfcCfgCfc CfgAfdTsdT | 1246 | UfCfgGfgCfgGfaCfgCfcGfaCf gAfgdTsdT | 1247 |
| 129 | 129-147 | ucGfuCfgGfcGfuCfcGfcCfc GfaGfdTsdT | 1248 | CfUfcGfgGfcGfgAfcGfcCfgAf cGfadTsdT | 1249 |
| 130 | 130-148 | cgUfcGfgCfgUfcCfgCfcCfg AfgUfdTsdT | 1250 | AfCfuCfgGfgCfgGfaCfgCfcGf aCfgdTsdT | 1251 |
| 131 | 131-149 | guCfgGfcGfuCfcGfcCfcGfa GfuCfdTsdT | 1252 | GfAfcUfcGfgGfcGfgAfcGfcCf gAfcdTsdT | 1253 |
| 132 | 132-150 | ucGfgCfgUfcCfgCfcCfgAfg UfcCfdTsdT | 1254 | GfGfaCfuCfgGfgCfgGfaCfgCf cGfadTsdT | 1255 |
| 135 | 135-153 | gcGfuCfcGfcCfcGfaGfuCfcC fcGfdTsdT | 1256 | CfGfgGfgAfcUfcGfgGfcGfgAf cGfcdTsdT | 1257 |
| 136 | 136-154 | cgUfcCfgCfcCfgAfgUfcCfcC fgCfdTsdT | 1258 | GfCfgGfgGfaCfuCfgGfgCfgGf aCfgdTsdT | 1259 |
| 141 | 141-159 | gcCfcGfaGfuCfcCfcGfcCfuC fgCfdTsdT | 1260 | GfCfgAfgGfcGfgGfgAfcUfcGf gGfcdTsdT | 1261 |
| 164 | 164-182 | aaCfgCfcAfcAfaCfcAfcCfgC fgCfdTsdT | 1262 | GfCfgCfgGfuGfgUfuGfuGfgCf gUfudTsdT | 1263 |
| 165 | 165-183 | acGfcCfaCfaAfcCfaCfcGfcG fcAfdTsdT | 1264 | UfGfcGfcGfgUfgGfuUfgUfgG fcGfudTsdT | 1265 |

TABLE 6-continued

EGFR siRNA Sequences with Chemical Modifications

| hs Id # | Sequence position in NM_005228.3 | sense strand sequence (5'-3') | SEQ ID NO: | antisense strand sequence (5'-3') | SEQ ID NO: |
|---|---|---|---|---|---|
| 166 | 166-184 | cgCfcAfcAfaCfcAfcCfgCfgCfaCfdTsdT | 1266 | GfUfgCfgCfgGfuGfgUfuGfugCfgdTsdT | 1267 |
| 168 | 168-186 | ccAfcAfaCfcAfcCfgCfgCfaCfgGfdTsdT | 1268 | CfCfgUfgCfgCfgGfuGfgUfuGfuGfgdTsdT | 1269 |
| 169 | 169-187 | caCfaAfcCfaCfcGfcGfcAfcGfgCfdTsdT | 1270 | GfCfcGfuGfcGfcGfgUfgGfuUfgUfgdTsdT | 1271 |
| 170 | 170-188 | acAfaCfcAfcCfgCfgCfaCfgGfcCfdTsdT | 1272 | GfGfcCfgUfgCfgCfgGfuGfgUfuGfudTsdT | 1273 |
| 247 | 247-265 | auGfcGfaCfcCfuCfcGfgGfaCfgGfdTsdT | 1274 | CfCfgUfcCfcGfgAfgGfgUfcGfcAfudTsdT | 1275 |
| 248 | 248-266 | ugCfgAfcCfcUfcCfgGfgAfcGfgCfdTsdT | 1276 | GfCfcGfuCfcCfgGfaGfgGfuCfgCfadTsdT | 1277 |
| 249 | 249-267 | gcGfaCfcCfuCfcGfgGfaCfgGfcCfdTsdT | 1278 | GfGfcCfgUfcCfcGfgAfgGfgUfcGfcdTsdT | 1279 |
| 251 | 251-269 | gaCfcCfuCfcGfgGfaCfgGfcCfgGfdTsdT | 1280 | CfCfgGfcCfgUfcCfcGfgAfgGfgUfcdTsdT | 1281 |
| 252 | 252-270 | acCfcUfcCfgGfgAfcGfgCfcGfgGfdTsdT | 1282 | CfCfcGfgCfcGfuCfcCfgGfaGfgGfudTsdT | 1283 |
| 254 | 254-272 | ccUfcCfgGfgAfcGfgCfcGfgGfgCfdTsdT | 1284 | GfCfcCfcGfgCfcGfuCfcCfgGfaGfgdTsdT | 1285 |
| 329 | 329-347 | agAfaAfgUfuUfgCfcAfaGfgCfaCfdTsdT | 1286 | GfUfgCfcUfuGfgCfaAfaCfuUfuCfudTsdT | 1287 |
| 330 | 330-348 | gaAfaGfuUfuGfcCfaAfgGfcAfcGfdTsdT | 1288 | CfGfuGfcCfuUfgGfcAfaAfcUfuUfcdTsdT | 1289 |
| 332 | 332-350 | aaGfuUfuGfcCfaAfgGfcAfcGfaGfdTsdT | 1290 | CfUfcGfuGfcCfuUfgGfcAfaAfcUfudTsdT | 1291 |
| 333 | 333-351 | agUfuUfgCfcAfaGfgCfaCfgAfgUfdTsdT | 1292 | AfCfuCfgUfgCfcUfuGfgCfaAfaCfudTsdT | 1293 |
| 334 | 334-352 | guUfuGfcCfaAfgGfcAfcGfaGfuAfdTsdT | 1294 | UfAfcUfcGfuGfcCfuUfgGfcAfaAfcdTsdT | 1295 |
| 335 | 335-353 | uuUfgCfcAfaGfgCfaCfgAfgUfaAfdTsdT | 1296 | UfUfaCfuCfgUfgCfcUfuGfgCfaAfadTsdT | 1297 |
| 336 | 336-354 | uuGfcCfaAfgGfcAfcGfaGfuAfaCfdTsdT | 1298 | GfUfuAfcUfcGfuGfcCfuUfgGfcAfadTsdT | 1299 |
| 337 | 337-355 | ugCfcAfaGfgCfaCfgAfgUfaAfcAfdTsdT | 1300 | UfGfuUfaCfuCfgUfgCfcUfuGfgCfadTsdT | 1301 |
| 338 | 338-356 | gcCfaAfgGfcAfcGfaGfuAfaCfaAfdTsdT | 1302 | UfUfgUfuAfcUfcGfuGfcCfuUfgGfcdTsdT | 1303 |
| 361 | 361-379 | acGfcAfgUfuGfgGfcAfcUfuUfuGfdTsdT | 1304 | CfAfaAfaGfuGfcCfcAfaCfuGfcGfudTsdT | 1305 |
| 362 | 362-380 | cgCfaGfuUfgGfgCfaCfuUfuUfgAfdTsdT | 1306 | UfCfaAfaAfgUfgCfcCfaAfcUfgCfgdTsdT | 1307 |
| 363 | 363-381 | gcAfgUfuGfgGfcAfcUfuUfuGfaAfdTsdT | 1308 | UfUfcAfaAfaGfuGfcCfcAfaCfuGfcdTsdT | 1309 |
| 364 | 364-382 | caGfuUfgGfgCfaCfuUfuUfgAfaGfdTsdT | 1310 | CfUfuCfaAfaAfgUfgCfcCfaAfcUfgdTsdT | 1311 |
| 365 | 365-383 | agUfuGfgGfcAfcUfuUfuGfaAfgAfdTsdT | 1312 | UfCfuUfcAfaAfaGfuGfcCfcAfaCfudTsdT | 1313 |

TABLE 6-continued

EGFR siRNA Sequences with Chemical Modifications

| hs Id # | Sequence position in NM_ 005228.3 | sense strand sequence (5'-3') | SEQ ID NO: | antisense strand sequence (5'-3') | SEQ ID NO: |
|---|---|---|---|---|---|
| 366 | 366-384 | guUfgGfgCfaCfuUfuUfgAfaGfaUfdTsdT | 1314 | AfUfcUfuCfaAfaAfgUfgCfcCfaAfcdTsdT | 1315 |
| 367 | 367-385 | uuGfgGfcAfcUfuUfuGfaAfgAfuCfdTsdT | 1316 | GfAfuCfuUfcAfaAfaGfuGfcCfcAfadTsdT | 1317 |
| 368 | 368-386 | ugGfgCfaCfuUfuUfgAfaGfaUfcAfdTsdT | 1318 | UfGfaUfcUfuCfaAfaAfgUfgCfcCfadTsdT | 1319 |
| 369 | 369-387 | ggGfcAfcUfuUfuGfaAfgAfuCfaUfdTsdT | 1320 | AfUfgAfuCfuUfcAfaAfaGfuGfcCfcdTsdT | 1321 |
| 377 | 377-395 | uuGfaAfgAfuCfaUfuUfuCfuCfaGfdTsdT | 1322 | CfUfgAfgAfaAfaUfgAfuCfuUfcAfadTsdT | 1323 |
| 379 | 379-397 | gaAfgAfuCfaUfuUfuCfuCfaGfcCfdTsdT | 1324 | GfGfcUfgAfgAfaAfaUfgAfuCfuUfcdTsdT | 1325 |
| 380 | 380-398 | aaGfaUfcAfuUfuUfcUfcAfgCfcUfdTsdT | 1326 | AfGfgCfuGfaGfaAfaAfuGfaUfcUfudTsdT | 1327 |
| 385 | 385-403 | caUfuUfuCfuCfcAfgCfcUfcCfAfgAfdTsdT | 1328 | UfCfuGfgAfgGfcUfgAfgAfaAfaUfgdTsdT | 1329 |
| 394 | 394-412 | agCfcUfcCfaGfaGfgAfuGfuUfcAfdTsdT | 1330 | UfGfaAfcAfuCfcUfcUfgGfaGfgCfudTsdT | 1331 |
| 396 | 396-414 | ccUfcCfaGfaGfgAfuGfuUfcAfaUfdTsdT | 1332 | AfUfuGfaAfcAfuCfcUfcUfgGfaGfgdTsdT | 1333 |
| 397 | 397-415 | cuCfcAfgAfgGfaUfgUfuCfaAfuAfdTsdT | 1334 | UfAfuUfgAfaCfaUfcCfuCfuGfgAfgdTsdT | 1335 |
| 401 | 401-419 | agAfgGfaUfgUfuCfaAfuAfaCfuGfdTsdT | 1336 | CfAfgUfuAfuUfgAfaCfaUfcCfuCfudTsdT | 1337 |
| 403 | 403-421 | agGfaUfgUfuCfaAfuAfaCfuGfuGfdTsdT | 1338 | CfAfcAfgUfuAfuUfgAfaCfaUfcCfudTsdT | 1339 |
| 407 | 407-425 | ugUfuCfaAfuAfaCfuGfuGfaGfgUfdTsdT | 1340 | AfCfcUfcAfcAfgUfuAfuUfgAfaCfadTsdT | 1341 |
| 409 | 409-427 | uuCfaAfuAfaCfuGfuGfaGfgUfgGfdTsdT | 1342 | CfCfaCfcUfcAfcAfgUfuAfuUfgAfadTsdT | 1343 |
| 410 | 410-428 | ucAfaUfaAfcUfgUfgAfgGfuGfgUfdTsdT | 1344 | AfCfcAfcCfuCfaCfaGfuUfaUfuGfadTsdT | 1345 |
| 411 | 411-429 | caAfuAfaCfuGfuGfaGfgUfgGfuCfdTsdT | 1346 | GfAfcCfaCfcUfcAfcAfgUfuAfuUfgdTsdT | 1347 |
| 412 | 412-430 | aaUfaAfcUfgUfgAfgGfuGfgUfcCfdTsdT | 1348 | GfGfaCfcAfcCfuCfaCfaGfuUfaUfudTsdT | 1349 |
| 413 | 413-431 | auAfaCfuGfuGfaGfgUfgGfuCfcUfdTsdT | 1350 | AfGfgAfcCfaCfcUfcAfcAfgUfuAfudTsdT | 1351 |
| 414 | 414-432 | uaAfcUfgUfgAfgGfuGfgUfcCfuUfdTsdT | 1352 | AfAfgGfaCfcAfcCfuCfaCfaGfuUfadTsdT | 1353 |
| 416 | 416-434 | acUfgUfgAfgGfuGfgUfcCfuUfgGfdTsdT | 1354 | CfCfaAfgGfaCfcAfcCfuCfaCfaGfudTsdT | 1355 |
| 418 | 418-436 | ugUfgAfgGfuGfgUfcCfuUfgGfgAfdTsdT | 1356 | UfCfcCfaAfgGfaCfcAfcCfuCfaCfadTsdT | 1357 |
| 419 | 419-437 | guGfaGfgUfgGfuCfcUfuGfgGfaAfdTsdT | 1358 | UfUfcCfcAfaGfgAfcCfaCfcUfcAfcdTsdT | 1359 |
| 425 | 425-443 | ugGfuCfcUfuGfgGfaAfuUfuGfgAfdTsdT | 1360 | UfCfcAfaAfuUfcCfcAfaGfgAfcCfadTsdT | 1361 |

TABLE 6-continued

EGFR siRNA Sequences with Chemical Modifications

| hs Id # | Sequence position in NM_005228.3 | sense strand sequence (5'-3') | SEQ ID NO: | antisense strand sequence (5'-3') | SEQ ID NO: |
|---|---|---|---|---|---|
| 431 | 431-449 | uuGfgGfaAfuUfuGfgAfaAfu UfaCfdTsdT | 1362 | GfUfaAfuUfcCfcAfaAfuUfcCf cAfadTsdT | 1363 |
| 432 | 432-450 | ugGfgAfaUfuUfgGfaAfaUfu AfcCfdTsdT | 1364 | GfGfuAfaUfuUfcCfaAfaUfuCf cCfadTsdT | 1365 |
| 433 | 433-451 | ggGfaAfuUfuGfgAfaAfuUfa CfcCfdTsdT | 1366 | AfGfgUfaAfuUfuCfcAfaAfuUf cCfcdTsdT | 1367 |
| 434 | 434-452 | ggAfaUfuUfgGfaAfaUfuAfc CfuCfdTsdT | 1368 | UfAfgGfuAfaUfuUfcCfaAfaUf uCfcdTsdT | 1369 |
| 458 | 458-476 | agAfgGfaAfuUfaUfgAfuCfu UfuCfdTsdT | 1370 | GfAfaAfgAfuCfaUfaAfuUfcCf uCfudTsdT | 1371 |
| 459 | 459-477 | gaGfgAfaUfuAfuGfaUfcUfu UfcCfdTsdT | 1372 | GfGfaAfaGfaUfcAfuAfaUfuCf cUfcdTsdT | 1373 |
| 463 | 463-481 | aaUfaAfuGfaUfcUfuUfcCfu UfcUfdTsdT | 1374 | AfGfaAfgGfaAfaGfaUfcAfuAf aUfudTsdT | 1375 |
| 464 | 464-482 | auUfaAfuGfaUfcUfuUfcCfu CfuUfdTsdT | 1376 | AfAfgAfaGfgAfaAfgAfuCfaUf aAfudTsdT | 1377 |
| 466 | 466-484 | uaUfgAfuCfuUfuCfcCfuUfcu UfaAfdTsdT | 1378 | UfUfaAfgAfaGfgAfaAfgAfuCf aUfadTsdT | 1379 |
| 468 | 468-486 | ugAfuCfuUfuCfcCfuUfcUfa AfaGfdTsdT | 1380 | CfUfuUfaAfgAfaGfgAfaAfgAf uCfadTsdT | 1381 |
| 471 | 471-489 | ucUfuUfcCfuUfcUfuAfaAfg AfcCfdTsdT | 1382 | GfGfuCfuUfuAfaGfaAfgGfaAf aGfadTsdT | 1383 |
| 476 | 476-494 | ccUfuCfuUfaAfaGfaCfcAfu CfcAfdTsdT | 1384 | UfGfgAfuGfgUfcUfuUfaAfgA faGfgdTsdT | 1385 |
| 477 | 477-495 | cuUfcUfuAfaAfgAfcCfaUfc CfaGfdTsdT | 1386 | CfUfgGfaUfgGfuCfuUfuAfaGf aAfgdTsdT | 1387 |
| 479 | 479-497 | ucUfuAfaAfgAfcCfaUfcCfa GfgAfdTsdT | 1388 | UfCfcUfgGfaUfgGfuCfuUfuAf aGfadTsdT | 1389 |
| 481 | 481-499 | uuAfaAfgAfcCfaUfcCfaGfg AfgGfdTsdT | 1390 | CfCfuCfcUfgGfaUfgGfuCfuUf uAfadTsdT | 1391 |
| 482 | 482-500 | uaAfaGfaCfcAfuCfcAfgGfa GfgUfdTsdT | 1392 | AfCfcUfcCfuGfgAfuGfgUfcUf uUfadTsdT | 1393 |
| 492 | 492-510 | ccAfgGfaGfgUfgGfcUfgGfu UfaUfdTsdT | 1394 | AfUfaAfcCfaGfcCfaCfcUfcCf uGfgdTsdT | 1395 |
| 493 | 493-511 | caGfgAfgGfuGfgCfuGfgUfu AfuGfdTsdT | 1396 | CfAfuAfaCfcAfgCfcAfcCfuCf cUfgdTsdT | 1397 |
| 494 | 494-512 | agGfaGfgUfgGfcUfgGfuUfa UfgUfdTsdT | 1398 | AfCfaUfaAfcCfaGfcCfaCfcUfc CfudTsdT | 1399 |
| 495 | 495-513 | ggAfgGfuGfgCfuGfgUfuAfu GfuCfdTsdT | 1400 | GfAfcAfuAfaCfcAfgCfcAfcCf uCfcdTsdT | 1401 |
| 496 | 496-514 | gaGfgUfgGfcUfgGfuUfaUfg UfcCfdTsdT | 1402 | GfGfaCfaUfaAfcCfaGfcCfaCfc UfcdTsdT | 1403 |
| 497 | 497-515 | agGfuGfgCfuGfgUfuAfuGfu CfcUfdTsdT | 1404 | AfGfgAfcAfuAfaCfcAfgCfcAf cCfudTsdT | 1405 |
| 499 | 499-517 | guGfgCfuGfgUfuAfuGfuCfc UfcAfdTsdT | 1406 | UfGfaGfgAfcAfuAfaCfcAfgCf cAfcdTsdT | 1407 |
| 520 | 520-538 | gcCfcUfcAfaCfaCfaGfuGfg AfgCfdTsdT | 1408 | GfCfuCfcAfcUfgUfgUfuGfaGf gGfcdTsdT | 1409 |

TABLE 6-continued

EGFR siRNA Sequences with Chemical Modifications

| hs Id # | Sequence position in NM_005228.3 | sense strand sequence (5'-3') | SEQ ID NO: | antisense strand sequence (5'-3') | SEQ ID NO: |
|---|---|---|---|---|---|
| 542 | 542-560 | uuCfcUfuUfgGfaAfaAfcCfuGfcAfdTsdT | 1410 | UfGfcAfgGfuUfuUfcCfaAfaGfgAfadTsdT | 1411 |
| 543 | 543-561 | ucCfuUfuGfgAfaAfaCfcUfgCfaGfdTsdT | 1412 | CfUfgCfaGfgUfuUfuCfcAfaAfgGfadTsdT | 1413 |
| 550 | 550-568 | gaAfaAfcCfuGfcAfgAfuCfaUfcAfdTsdT | 1414 | UfGfaUfgAfuCfuGfcAfgGfuUfuUfcdTsdT | 1415 |
| 551 | 551-569 | aaAfaCfcUfgCfaGfaUfcAfuCfaGfdTsdT | 1416 | CfUfgAfuGfaUfcUfgCfaGfgUfuUfudTsdT | 1417 |
| 553 | 553-571 | aaCfcUfgCfaGfaUfcAfuCfaGfaGfdTsdT | 1418 | CfUfcUfgAfuGfaUfcUfgCfaGfgUfudTsdT | 1419 |
| 556 | 556-574 | cuGfcAfgAfuCfaUfcAfgAfgGfaAfdTsdT | 1420 | UfUfcCfuCfuGfaUfgAfuCfuGfcAfgdTsdT | 1421 |
| 586 | 586-604 | gaAfaAfuUfcCfuAfuGfcCfuUfaGfdTsdT | 1422 | CfUfaAfgGfcAfuAfgGfaAfuUfuUfcdTsdT | 1423 |
| 587 | 587-605 | aaAfaUfuCfcUfaUfgCfcUfuAfgCfdTsdT | 1424 | GfCfuAfaGfgCfaUfaGfgAfaUfuUfudTsdT | 1425 |
| 589 | 589-607 | aaUfuCfcUfaUfgCfcUfuAfgCfaGfdTsdT | 1426 | CfUfgCfuAfaGfgCfaUfaGfgAfaUfudTsdT | 1427 |
| 592 | 592-610 | ucCfuAfuGfcCfuUfaGfcAfgUfcUfdTsdT | 1428 | AfGfaCfuGfcUfaAfgGfcAfuAfgGfadTsdT | 1429 |
| 593 | 593-611 | ccUfaUfgCfcUfuAfgCfaGfuCfuUfdTsdT | 1430 | AfAfgAfcUfgCfuAfaGfgCfaUfaGfgdTsdT | 1431 |
| 594 | 594-612 | cuAfuGfcCfuUfaGfcAfgUfcUfuAfdTsdT | 1432 | UfAfaGfaCfuGfcUfaAfgGfcAfuAfgdTsdT | 1433 |
| 596 | 596-614 | auGfcCfuUfaGfcAfgUfcUfuAfuCfdTsdT | 1434 | GfAfuAfaGfaCfuGfcUfaAfgGfcAfudTsdT | 1435 |
| 597 | 597-615 | ugCfcUfuAfgCfaGfuCfuUfaUfcUfdTsdT | 1436 | AfGfaUfaAfgAfcUfgCfuAfaGfgCfadTsdT | 1437 |
| 598 | 598-616 | gcCfuUfaGfcAfgUfcUfuAfuCfuAfdTsdT | 1438 | UfAfgAfuAfaGfaCfuGfcUfaAfgGfcdTsdT | 1439 |
| 599 | 599-617 | ccUfaGfcAfgUfcUfuAfuCfuAfaGfdTsdT | 1440 | UfUfaGfaUfaAfgAfcUfgCfuAfaGfgdTsdT | 1441 |
| 600 | 600-618 | cuUfaGfcAfgUfcUfuAfuCfuAfaCfdTsdT | 1442 | GfUfuAfgAfuAfaGfaCfuGfcUfaAfgdTsdT | 1443 |
| 601 | 601-619 | uuAfgCfaGfuCfuUfaUfcUfaAfcUfdTsdT | 1444 | AfGfuUfaGfaUfaAfgAfcUfgCfuAfadTsdT | 1445 |
| 602 | 602-620 | uaGfcAfgUfcUfuAfuCfuAfaCfuAfdTsdT | 1446 | UfAfgUfuAfgAfuAfaGfaCfuGfcUfadTsdT | 1447 |
| 603 | 603-621 | agCfaGfuCfuUfaUfcUfaAfcUfaUfdTsdT | 1448 | AfUfaGfuUfaGfaUfaAfgAfcUfgCfudTsdT | 1449 |
| 604 | 604-622 | gcAfgUfcUfuAfuCfuAfaCfuAfuAfdTsdT | 1450 | CfAfuAfgUfuAfgAfuAfaGfaCfuGfcdTsdT | 1451 |
| 605 | 605-623 | caGfuCfuUfaUfcUfaAfcUfaUfgAfdTsdT | 1452 | UfCfaUfaGfuUfaGfaUfaAfgAfcUfgdTsdT | 1453 |
| 608 | 608-626 | ucUfuAfuCfuAfaCfuAfuGfaUfgCfdTsdT | 1454 | GfCfaUfcAfuAfgUfuAfgAfuAfaGfadTsdT | 1455 |
| 609 | 609-627 | cuUfaUfcUfaAfcUfaUfgAfuGfcAfdTsdT | 1456 | UfGfcAfuCfaUfaGfuUfaGfaUfaAfgdTsdT | 1457 |

TABLE 6-continued

EGFR siRNA Sequences with Chemical Modifications

| hs Id # | Sequence position in NM_005228.3 | sense strand sequence (5'-3') | SEQ ID NO: | antisense strand sequence (5'-3') | SEQ ID NO: |
|---|---|---|---|---|---|
| 610 | 610-628 | uuAfuCfuAfaCfuAfuGfaUfg faAfdTsdT | 1458 | UfUfgCfaUfcAfuAfgUfuAfgAf uAfadTsdT | 1459 |
| 611 | 611-629 | uaUfcUfaAfcUfaUfgAfuGfc AfaAfdTsdT | 1460 | UfUfuGfcAfuCfaUfaGfuUfaGf aUfadTsdT | 1461 |
| 612 | 612-630 | auCfuAfaCfuAfuGfaUfgCfa AfaUfdTsdT | 1462 | AfUfuUfgCfaUfcAfuAfgUfuAf gAfudTsdT | 1463 |
| 613 | 613-631 | ucUfaAfcUfaUfgAfuGfcAfa AfuAfdTsdT | 1464 | UfAfuUfgCfaUfcAfuAfgUfuAf aGfadTsdT | 1465 |
| 614 | 614-632 | cuAfaCfuAfuGfaUfgCfaAfa UfaAfdTsdT | 1466 | UfUfaUfuUfgCfaUfcAfuAfgUf uAfgdTsdT | 1467 |
| 616 | 616-634 | aaCfuAfuGfaUfgCfaAfaUfa AfaAfdTsdT | 1468 | UfUfuUfaUfuUfgCfaUfcAfuAf gUfudTsdT | 1469 |
| 622 | 622-640 | gaUfgCfaAfaUfaAfaAfcCfg GfaCfdTsdT | 1470 | GfUfcCfgGfuUfuUfaUfuUfgCf aUfcdTsdT | 1471 |
| 623 | 623-641 | auGfcAfaAfuAfaAfaCfcGfg AfcUfdTsdT | 1472 | AfGfuCfcGfgUfuUfuAfuUfuG fcAfudTsdT | 1473 |
| 624 | 624-642 | ugCfaAfaUfaAfaAfcCfgGfa CfuGfdTsdT | 1474 | CfAfgUfcCfgGfuUfuUfaUfuUf gCfadTsdT | 1475 |
| 626 | 626-644 | caAfaUfaAfaAfcCfgGfaCfu GfaAfdTsdT | 1476 | UfUfcAfgUfcCfgGfuUfuUfaUf uUfgdTsdT | 1477 |
| 627 | 627-645 | aaAfuAfaAfaCfcGfgAfcUfg AfaGfdTsdT | 1478 | CfUfuCfaGfuCfcGfgUfuUfuAf uUfudTsdT | 1479 |
| 628 | 628-646 | aaUfaAfaAfcCfgGfaCfuGfa AfgGfdTsdT | 1480 | CfCfuUfcAfgUfcCfgGfuUfuUf aUfudTsdT | 1481 |
| 630 | 630-648 | uaAfaAfcCfgGfaCfuGfaAfg GfaGfdTsdT | 1482 | CfUfcCfuUfcAfgUfcCfgGfuUf uUfadTsdT | 1483 |
| 631 | 631-649 | aaAfaCfcGfgAfcUfgAfaGfg AfgCfdTsdT | 1484 | GfCfuCfcUfuCfaGfuCfcGfgUf uUfudTsdT | 1485 |
| 632 | 632-650 | aaAfcCfgGfaCfuGfaAfgGfa GfcUfdTsdT | 1486 | AfGfcUfcCfuUfcAfgUfcCfgGf uUfudTsdT | 1487 |
| 633 | 633-651 | aaCfgGfaCfuGfaAfgGfaGfg CfuGfdTsdT | 1488 | CfAfgCfuCfcUfuCfaGfuCfcGf gUfudTsdT | 1489 |
| 644 | 644-662 | agGfaGfcUfgCfcCfaUfgAfg AfaAfdTsdT | 1490 | UfUfuCfuCfaUfgGfgCfaGfcUf cCfudTsdT | 1491 |
| 665 | 665-683 | uaCfaGfgAfaAfuCfcUfgCfa UfgGfdTsdT | 1492 | CfCfaUfgCfaGfgAfuUfuCfcUf gUfadTsdT | 1493 |
| 668 | 668-686 | agGfaAfaUfcCfuGfcAfuGfg CfgCfdTsdT | 1494 | GfCfgCfcAfuGfcAfgGfaUfuUf cCfudTsdT | 1495 |
| 669 | 669-687 | ggAfaAfuCfcUfgCfaUfgGfc GfcCfdTsdT | 1496 | GfGfcGfcCfaUfgCfaGfgAfuUf uCfcdTsdT | 1497 |
| 670 | 670-688 | gaAfaUfcCfuGfcAfuGfgCfg CfcGfdTsdT | 1498 | CfGfgCfgCfcAfuGfcAfgGfaUf uUfcdTsdT | 1499 |
| 671 | 671-689 | aaAfuCfcUfgCfaUfgGfcGfc CfgUfdTsdT | 1500 | AfCfgGfcGfcCfaUfgCfaGfgAf uUfudTsdT | 1501 |
| 672 | 672-690 | aaUfcCfuGfcAfuGfgCfgCfc GfuGfdTsdT | 1502 | CfAfcGfgCfgCfcAfuGfcAfgGf aUfudTsdT | 1503 |
| 674 | 674-692 | ucCfuGfcAfuGfgCfgCfcGfu GfcGfdTsdT | 1504 | CfGfcAfcGfgCfgCfcAfuGfcAf gGfadTsdT | 1505 |

TABLE 6-continued

EGFR siRNA Sequences with Chemical Modifications

| hs Id # | Sequence position in NM_005228.3 | sense strand sequence (5'-3') | SEQ ID NO: | antisense strand sequence (5'-3') | SEQ ID NO: |
|---|---|---|---|---|---|
| 676 | 676-694 | cuGfcAfuGfgCfgCfcGfuGfc GfgUfdTsdT | 1506 | AfCfcGfcAfcGfgCfgCfcAfuGf cAfgdTsdT | 1507 |
| 677 | 677-695 | ugCfaUfgGfcGfcCfgUfgCfg GfuUfdTsdT | 1508 | AfAfcCfgCfaCfgGfcGfcCfaUf gCfadTsdT | 1509 |
| 678 | 678-696 | gcAfuGfcGfgCfcGfuGfcGfg UfuCfdTsdT | 1510 | GfAfaCfcGfcAfcGfgCfgCfcAf uGfcdTsdT | 1511 |
| 680 | 680-698 | auGfgCfgCfcGfuGfcGfgUfu CfaGfdTsdT | 1512 | CfUfgAfaCfcGfcAfcGfgCfgCf cAfudTsdT | 1513 |
| 681 | 681-699 | ugGfcGfcCfgUfgCfgGfuUfc AfgCfdTsdT | 1514 | GfCfuGfaAfcCfgCfaCfgGfcGf cCfadTsdT | 1515 |
| 682 | 682-700 | ggCfgCfcGfuGfcGfgUfuCfa GfcAfdTsdT | 1516 | UfGfcUfgAfaCfcGfcAfcGfgCf gCfcdTsdT | 1517 |
| 683 | 683-701 | gcGfcCfgUfgCfgGfuUfcAfg CfaAfdTsdT | 1518 | UfUfgCfuGfaAfcCfgCfaCfgGf cGfcdTsdT | 1519 |
| 684 | 684-702 | cgCfcGfuGfcGfgUfuCfaGfc AfaCfdTsdT | 1520 | GfUfuGfcUfgAfaCfcGfcAfcGf gCfgdTsdT | 1521 |
| 685 | 685-703 | gcCfgUfgCfgGfuUfcAfgCfa AfcAfdTsdT | 1522 | UfGfuUfgCfuGfaAfcCfgCfaCf gGfcdTsdT | 1523 |
| 686 | 686-704 | ccGfuGfcGfgUfuCfaGfcAfa CfaAfdTsdT | 1524 | UfUfgUfuGfcUfgAfaCfcGfcAf cGfgdTsdT | 1525 |
| 688 | 688-706 | guGfcGfgUfuCfaGfcAfaCfa AfcCfdTsdT | 1526 | GfGfuUfgUfuGfcUfgAfaCfcGf cAfcdTsdT | 1527 |
| 690 | 690-708 | gcGfgUfuCfaGfcAfaCfaAfc CfcUfdTsdT | 1528 | AfGfgGfuUfgUfuGfcUfgAfaCf cGfcdTsdT | 1529 |
| 692 | 692-710 | ggUfuCfaGfcAfaCfaAfcCfc UfgCfdTsdT | 1530 | GfCfaGfgGfuUfgUfuGfcUfgAf aCfcdTsdT | 1531 |
| 698 | 698-716 | gcAfaCfaAfcCfcUfgCfcCfuG fuGfdTsdT | 1532 | CfAfcAfgGfgCfaGfgGfuUfgUf uGfcdTsdT | 1533 |
| 700 | 700-718 | aaCfaAfcCfcUfgCfcCfuGfuG fcAfdTsdT | 1534 | UfGfcAfcAfgGfgCfaGfgGfuUf gUfudTsdT | 1535 |
| 719 | 719-737 | acGfuGfgAfgAfgCfaUfcCfa GfuGfdTsdT | 1536 | CfAfcUfgGfaUfgCfuCfuCfcAf cGfudTsdT | 1537 |
| 720 | 720-738 | cgUfgGfaGfaGfcAfuCfcAfg UfgGfdTsdT | 1538 | CfCfaCfuGfgAfuGfcUfcUfcCf aCfgdTsdT | 1539 |
| 721 | 721-739 | guGfgAfgAfgCfaUfcCfaGfu GfgCfdTsdT | 1540 | GfCfcAfcUfgGfaUfgCfuCfuCf cAfcdTsdT | 1541 |
| 724 | 724-742 | gaGfaGfcAfuCfcAfgUfgGfc GfgGfdTsdT | 1542 | CfCfcGfcCfaCfuGfgAfuGfcUf cUfcdTsdT | 1543 |
| 725 | 725-743 | agAfgCfaUfcCfaGfuGfgCfg GfgAfdTsdT | 1544 | UfCfcCfgCfcAfcUfgGfaUfgCf uCfudTsdT | 1545 |
| 726 | 726-744 | gaGfcAfuCfcAfgUfgGfcGfg GfaCfdTsdT | 1546 | GfUfcCfcGfcCfaCfuGfgAfuGf cUfcdTsdT | 1547 |
| 733 | 733-751 | caGfuGfgCfgGfgAfcAfuAfg UfcAfdTsdT | 1548 | UfGfaCfuAfuGfuCfcCfgCfcAf cUfgdTsdT | 1549 |
| 734 | 734-752 | agUfgGfcGfgGfaCfaUfaGfu CfaGfdTsdT | 1550 | CfUfgAfcUfaUfgUfcCfcGfcCf aCfudTsdT | 1551 |
| 736 | 736-754 | ugGfcGfgGfaCfaUfaGfuCfa GfcAfdTsdT | 1552 | UfGfcUfgAfcUfaUfgUfcCfcGf cCfadTsdT | 1553 |

TABLE 6-continued

EGFR siRNA Sequences with Chemical Modifications

| hs Id # | Sequence position in NM_ 005228.3 | sense strand sequence (5'-3') | SEQ ID NO: | antisense strand sequence (5'-3') | SEQ ID NO: |
|---|---|---|---|---|---|
| 737 | 737-755 | ggCfgGfgAfcAfuAfgUfcAfgCfaGfdTsdT | 1554 | CfUfgCfuGfaCfuAfuGfuCfcCfgCfcdTsdT | 1555 |
| 763 | 763-781 | cuCfaGfcAfaCfaUfgUfcGfaUfgGfdTsdT | 1556 | CfCfaUfcGfaCfaUfgUfuGfcUfgAfgdTsdT | 1557 |
| 765 | 765-783 | caGfcAfaCfaUfgUfcGfaUfgGfaCfdTsdT | 1558 | GfUfcCfaUfcGfaCfaUfgUfuGfcUfgdTsdT | 1559 |
| 766 | 766-784 | agCfaAfcAfuGfuCfgAfuGfgAfcUfdTsdT | 1560 | AfGfuCfcAfuCfgAfcAfuGfuUfgCfudTsdT | 1561 |
| 767 | 767-785 | gcAfaCfaUfgUfcGfaUfgGfaCfuUfdTsdT | 1562 | AfAfgUfcCfaUfcGfaCfaUfgUfuGfcdTsdT | 1563 |
| 769 | 769-787 | aaCfaUfgUfcGfaUfgGfaCfuUfcCfdTsdT | 1564 | GfGfaAfgUfcCfaUfcGfaCfaUfgUfudTsdT | 1565 |
| 770 | 770-788 | acAfuGfuCfgAfuGfgAfcUfuCfcAfdTsdT | 1566 | UfGfgAfaGfuCfcAfuCfgAfcAfuGfudTsdT | 1567 |
| 771 | 771-789 | caUfgUfcGfaUfgGfaCfuUfcCfaGfdTsdT | 1568 | CfUfgGfaAfgUfcCfaUfcGfaCfaUfgdTsdT | 1569 |
| 772 | 772-790 | auGfuCfgAfuGfgAfcUfuCfcAfgAfdTsdT | 1570 | UfCfuGfgAfaGfuCfcAfuCfgAfcAfudTsdT | 1571 |
| 775 | 775-793 | ucGfaUfgGfaCfuUfcCfaGfaAfcCfdTsdT | 1572 | GfGfuUfcUfgGfaAfgUfcCfaUfcGfadTsdT | 1573 |
| 789 | 789-807 | gaAfcCfaCfcUfgGfcGfaGfcUfgCfdTsdT | 1574 | GfCfaGfcUfgCfcAfgGfuGfuUfcdTsdT | 1575 |
| 798 | 798-816 | ggGfcAfgCfuGfcCfaAfaAfgUfgUfdTsdT | 1576 | AfCfaCfuUfuUfgGfcAfgCfuGfcCfcdTsdT | 1577 |
| 800 | 800-818 | gcAfgCfuGfcCfaAfaAfgUfgUfgAfdTsdT | 1578 | UfCfaCfaCfuUfuUfgGfcAfgCfuGfcdTsdT | 1579 |
| 805 | 805-823 | ugCfcAfaAfaGfuGfuGfaUfcCfaAfdTsdT | 1580 | UfUfgGfaUfcAfcAfcUfuUfuGfgCfadTsdT | 1581 |
| 806 | 806-824 | gcCfaAfaAfgUfgUfgAfuCfcAfaGfdTsdT | 1582 | CfUfuGfgAfuCfaCfaCfuUfuUfgGfcdTsdT | 1583 |
| 807 | 807-825 | ccAfaAfaGfuGfuGfaUfcCfaAfgCfdTsdT | 1584 | GfCfuUfgGfaUfcAfcAfcUfuUfuGfgdTsdT | 1585 |
| 810 | 810-828 | aaAfgUfgUfgAfuCfcAfaGfcUfgUfdTsdT | 1586 | AfCfaGfcUfuGfgAfuCfaCfaCfuUfudTsdT | 1587 |
| 814 | 814-832 | ugUfgAfuCfcAfaGfcUfgUfcCfcAfdTsdT | 1588 | UfGfgGfaCfaGfcUfuGfgAfuCfaCfadTsdT | 1589 |
| 815 | 815-833 | guGfaUfcCfaAfgCfuGfuCfcCfaAfdTsdT | 1590 | UfUfgGfgAfcAfgCfuUfgGfaUfcAfcdTsdT | 1591 |
| 817 | 817-835 | gaUfcCfaAfgCfuGfuCfcCfaAfuGfdTsdT | 1592 | CfAfuUfgGfgAfcAfgCfuUfgGfaUfcdTsdT | 1593 |
| 818 | 818-836 | auCfcAfaGfcUfgUfcCfcAfaUfgGfdTsdT | 1594 | CfCfaUfuGfgGfaCfaGfcUfuGfgAfudTsdT | 1595 |
| 819 | 819-837 | ucCfaAfgCfuGfuCfcCfaAfuGfgGfdTsdT | 1596 | CfCfcAfuUfgGfgAfcAfgCfuUfgGfadTsdT | 1597 |
| 820 | 820-838 | ccAfaGfcUfgUfcCfcAfaUfgGfgAfdTsdT | 1598 | UfCfcCfaUfuGfgGfaCfaGfcUfuGfudTsdT | 1599 |
| 821 | 821-839 | caAfgCfuGfuCfcCfaAfuGfgGfaGfdTsdT | 1600 | CfUfcCfcAfuUfgGfgAfcAfgCfuUfgdTsdT | 1601 |

TABLE 6-continued

EGFR siRNA Sequences with Chemical Modifications

| hs Id # | Sequence position in NM_005228.3 | sense strand sequence (5'-3') | SEQ ID NO: | antisense strand sequence (5'-3') | SEQ ID NO: |
|---|---|---|---|---|---|
| 823 | 823-841 | agCfuGfuCfcCfaAfuGfgGfaGfcUfdTsdT | 1602 | AfGfcUfcCfcAfuUfgGfgAfcAfgCfudTsdT | 1603 |
| 826 | 826-844 | ugUfcCfcAfaAfuGfgAfgCfuGfcUfdTsdT | 1604 | AfGfcAfgCfuCfcAfuUfgGfaCfadTsdT | 1605 |
| 847 | 847-865 | ggUfgCfaGfgAfgAfgGfaGfaAfcUfdTsdT | 1606 | AfGfuUfcUfcCfcUfcUfcCfuGfcaCfcdTsdT | 1607 |
| 871 | 871-889 | aaAfcUfgAfcCfaAfaAfuCfaUfcUfdTsdT | 1608 | AfGfaUfgAfuUfuUfgGfuCfaGfuUfudTsdT | 1609 |
| 872 | 872-890 | aaCfuGfaCfcAfaAfaUfcAfuCfuGfdTsdT | 1610 | CfAfgAfuGfaUfuUfuGfgUfcAfgUfudTsdT | 1611 |
| 873 | 873-891 | acUfgAfcCfaAfaAfuCfaUfcUfgUfdTsdT | 1612 | AfCfaGfaUfgAfuUfuUfgGfuCfaGfudTsdT | 1613 |
| 877 | 877-895 | acCfaAfaAfuCfaUfcUfgUfgcCfdTsdT | 1614 | GfGfgCfaCfaGfaUfgAfuUfuUfgGfudTsdT | 1615 |
| 878 | 878-896 | ccAfaAfaUfcAfuCfuGfuGfcCfcAfdTsdT | 1616 | UfGfgGfcAfcAfgAfuGfaUfuUfuGfgdTsdT | 1617 |
| 881 | 881-899 | aaAfuCfaUfcUfgUfgCfcCfaGfcAfdTsdT | 1618 | UfGfcUfgGfgCfaCfaGfaUfgAfuUfudTsdT | 1619 |
| 890 | 890-908 | guGfcCfcAfgGfaGfuGfcUfcCfgGfdTsdT | 1620 | CfCfgGfaGfcAfcUfcCfuGfgGfcAfcdTsdT | 1621 |
| 892 | 892-910 | gcCfcAfgGfaGfuGfcUfcCfgGfgCfdTsdT | 1622 | GfCfcCfgGfaGfcAfcUfcCfuGfgGfcdTsdT | 1623 |
| 929 | 929-947 | ccAfgUfgAfcUfgCfuGfcCfaCfaAfdTsdT | 1624 | UfUfgUfgGfcAfgCfaGfuCfaCfuGfgdTsdT | 1625 |
| 930 | 930-948 | caGfuGfaCfuGfcUfgCfcAfcAfaCfdTsdT | 1626 | GfUfuGfuGfgCfaGfcAfgUfcAfcUfgdTsdT | 1627 |
| 979 | 979-997 | gaGfaGfcGfaCfuGfcCfuGfgUfcUfdTsdT | 1628 | AfGfaCfcAfgGfcAfgUfcGfcUfcUfcdTsdT | 1629 |
| 980 | 980-998 | agAfgCfgAfcUfgCfcUfgGfuCfuGfdTsdT | 1630 | CfAfgAfcCfaGfgCfaGfuCfgCfuCfudTsdT | 1631 |
| 981 | 981-999 | gaGfcGfaCfuGfcCfuGfgUfcUfgCfdTsdT | 1632 | GfCfaGfaCfcAfgGfcAfgUfcGfcUfcdTsdT | 1633 |
| 982 | 982-1000 | agCfgAfcUfgCfcUfgGfuCfuGfcCfdTsdT | 1634 | GfGfcAfgAfcCfaGfgCfaGfuCfgCfudTsdT | 1635 |
| 983 | 983-1001 | gcGfaCfuGfcCfuGfgUfcUfgCfcGfdTsdT | 1636 | CfGfgCfaGfaCfcAfgGfcAfgUfcGfcdTsdT | 1637 |
| 984 | 984-1002 | cgAfcUfgCfcUfgGfuCfuGfcCfgCfdTsdT | 1638 | GfCfgGfcAfgAfcCfaGfgCfaGfuCfgdTsdT | 1639 |
| 989 | 989-1007 | gcCfuGfgUfcUfgCfcGfcAfaAfuUfdTsdT | 1640 | AfAfuUfuGfcGfgCfaGfaCfcAfgGfcdTsdT | 1641 |
| 990 | 990-1008 | ccUfgGfuCfuGfcCfgCfaAfaUfuCfdTsdT | 1642 | GfAfaUfuUfgCfgGfcAfgGfaCfcAfgdTsdT | 1643 |
| 991 | 991-1009 | cuGfgUfcUfgCfcGfcAfaAfuUfcCfdTsdT | 1644 | GfGfaAfuUfuGfcGfgCfaGfaCfcAfgdTsdT | 1645 |
| 992 | 992-1010 | ugGfuCfuGfcCfgCfaAfaUfuCfcGfdTsdT | 1646 | CfGfgAfaUfuUfgCfgGfcAfgAfccCfadTsdT | 1647 |
| 994 | 994-1012 | guCfuGfcCfgCfaAfaUfuCfcGfaGfdTsdT | 1648 | CfUfcGfgAfaUfuUfgCfgGfcAfgAfcdTsdT | 1649 |

TABLE 6-continued

EGFR siRNA Sequences with Chemical Modifications

| hs Id # | Sequence position in NM_005228.3 | sense strand sequence (5'-3') | SEQ ID NO: | antisense strand sequence (5'-3') | SEQ ID NO: |
|---|---|---|---|---|---|
| 995 | 995-1013 | ucUfgCfcGfcAfaAfuUfcCfg AfgAfdTsdT | 1650 | UfCfuCfgGfaAfuUfuGfcGfgCf aGfadTsdT | 1651 |
| 996 | 996-1014 | cuGfcCfgCfaAfaUfuCfcGfa GfaCfdTsdT | 1652 | GfUfcUfcGfgAfaUfuGfcGfgCf cAfgdTsdT | 1653 |
| 997 | 997-1015 | ugCfcGfcAfaAfuUfcCfgAfg AfcGfdTsdT | 1654 | CfGfuCfuCfgGfaAfuUfuGfcGf gCfadTsdT | 1655 |
| 999 | 999-1017 | ccGfcAfaAfuUfcCfgAfgAfc GfaAfdTsdT | 1656 | UfUfcGfuCfuCfgGfaAfuUfuGf cGfgdTsdT | 1657 |
| 1004 | 1004-1022 | aaUfuCfcGfaGfaCfgAfaGfcC faCfdTsdT | 1658 | GfUfgGfcUfuCfgUfcUfcGfgAf aUfudTsdT | 1659 |
| 1005 | 1005-1023 | auUfcCfgAfgAfcGfaAfgCfc AfcGfdTsdT | 1660 | CfGfuGfgCfuUfcGfuCfuCfgGf aAfudTsdT | 1661 |
| 1006 | 1006-1024 | uuCfcGfaGfaCfgAfaGfcCfaC fgUfdTsdT | 1662 | AfCfgUfgGfcUfuCfgUfcUfcGf gAfadTsdT | 1663 |
| 1007 | 1007-1025 | ucCfgAfgAfcGfaAfgCfcAfc GfuGfdTsdT | 1664 | CfAfcGfuGfgCfuUfcGfuCfuCf gGfadTsdT | 1665 |
| 1008 | 1008-1026 | ccGfaGfaCfgAfaGfcCfaCfgU fgCfdTsdT | 1666 | GfCfaCfgUfgGfcUfuCfgUfcUf cGfgdTsdT | 1667 |
| 1010 | 1010-1028 | gaGfaCfgAfaGfcCfaCfgUfg CfaAfdTsdT | 1668 | UfUfgCfaCfgUfgGfcUfuCfgUf cUfcdTsdT | 1669 |
| 1013 | 1013-1031 | acGfaAfgCfcAfcGfuGfcAfa GfgAfdTsdT | 1670 | UfCfcUfuGfcAfcGfuGfgCfuUf cGfudTsdT | 1671 |
| 1014 | 1014-1032 | cgAfaGfcCfaCfgUfgCfaAfg GfaCfdTsdT | 1672 | GfUfcCfuUfgCfaCfgUfgGfcUf uCfgdTsdT | 1673 |
| 1015 | 1015-1033 | gaAfgCfcAfcGfuGfcAfaGfg AfcAfdTsdT | 1674 | UfGfuCfcUfuGfcAfcGfuGfgCf uUfcdTsdT | 1675 |
| 1016 | 1016-1034 | aaGfcCfaCfgUfgCfaAfgGfaC faCfdTsdT | 1676 | GfUfgUfcCfuUfgCfaCfgUfgGf cUfudTsdT | 1677 |
| 1040 | 1040-1058 | ccCfcAfcUfcAfuUfgCfcUfcUfaC faAfdTsdT | 1678 | UfUfgUfaGfaGfcAfuGfaGfuGf gGfgdTsdT | 1679 |
| 1042 | 1042-1060 | ccAfcUfcAfuUfgCfcUfcUfaCfa AfcCfdTsdT | 1680 | GfGfuUfgUfaGfaGfcAfuGfaGf uGfgdTsdT | 1681 |
| 1044 | 1044-1062 | acUfcAfuUfgCfcUfcUfaCfaAfcC fcCfdTsdT | 1682 | GfGfgGfuUfgUfaGfaGfcAfuGf aGfudTsdT | 1683 |
| 1047 | 1047-1065 | caUfgCfuCfuAfcAfaCfcCfcA fcCfdTsdT | 1684 | GfGfuGfgGfuUfgUfaAfgAfgC faUfgdTsdT | 1685 |
| 1071 | 1071-1089 | ccAfgAfuGfgAfuGfuGfaAfc CfcCfdTsdT | 1686 | GfGfgGfuUfcAfcAfuCfcAfuCf uGfgdTsdT | 1687 |
| 1073 | 1073-1091 | agAfuGfgAfuGfuGfaAfcCfc CfgAfdTsdT | 1688 | UfCfgGfgGfuUfcAfcAfuCfcAf uCfudTsdT | 1689 |
| 1074 | 1074-1092 | gaUfgGfaUfgUfgAfaCfcCfc GfaGfdTsdT | 1690 | CfUfcGfgGfuUfcAfcAfuCfcAf uCfdTsdT | 1691 |
| 1075 | 1075-1093 | auGfgAfuGfuGfaAfcCfcCfg AfgGfdTsdT | 1692 | CfCfuCfgGfgGfuUfcAfcAfuCf cAfudTsdT | 1693 |
| 1077 | 1077-1095 | ggAfuGfuGfaAfcCfcCfgAfg GfgCfdTsdT | 1694 | GfCfcCfuCfgGfgGfuUfcAfcAf uCfcdTsdT | 1695 |
| 1078 | 1078-1096 | gaUfgUfgAfaCfcCfcGfaGfg GfcAfdTsdT | 1696 | UfGfcCfcUfcGfgGfgUfuCfaCf aUfcdTsdT | 1697 |

TABLE 6-continued

EGFR siRNA Sequences with Chemical Modifications

| hs Id # | Sequence position in NM_005228.3 | sense strand sequence (5'-3') | SEQ ID NO: | antisense strand sequence (5'-3') | SEQ ID NO: |
|---|---|---|---|---|---|
| 1080 | 1080-1098 | ugUfgAfaCfcCfcGfaGfgGfc AfaAfdTsdT | 1698 | UfUfuGfcCfcUfcGfgGfgUfuCf aCfadTsdT | 1699 |
| 1084 | 1084-1102 | aaCfcCfcGfaGfgGfcAfaAfu AfcAfdTsdT | 1700 | UfGfuAfuUfuGfcCfcUfcGfgGf gUfudTsdT | 1701 |
| 1085 | 1085-1103 | acCfcCfgAfgGfgCfaAfaUfaC faGfdTsdT | 1702 | CfUfgUfaUfuUfgCfcCfuCfgGf gGfudTsdT | 17,3 |
| 1087 | 1087-1105 | ccCfgAfgGfgCfaAfaUfaCfa GfcUfdTsdT | 1704 | AfGfcUfgUfaUfuUfgCfcCfuCf gGfgdTsdT | 17,5 |
| 1088 | 1088-1106 | ccGfaGfgGfcAfaAfuAfcAfg CfuUfdTsdT | 1706 | AfAfgCfuGfuAfuUfuUfgCfcCfUf cGfgdTsdT | 1707 |
| 1089 | 1089-1107 | cgAfgGfgCfaAfaUfaCfaGfc UfuUfdTsdT | 1708 | AfAfaGfcUfgUfaUfuUfgCfcCf uCfgdTsdT | 1709 |
| 1096 | 1096-1114 | aaAfuAfcAfgCfuUfuGfgUfg CfcAfdTsdT | 1710 | UfGfgCfaCfcAfaAfgCfuGfuAf uUfudTsdT | 1711 |
| 1097 | 1097-1115 | aaUfaCfaGfcUfuUfgGfuGfc CfaCfdTsdT | 1712 | GfUfgGfcAfcCfaAfaGfcUfgUf aUfudTsdT | 1713 |
| 1098 | 1098-1116 | auAfcAfgCfuUfuGfgUfgCfc AfcCfdTsdT | 1714 | GfGfuGfgCfaCfcAfaAfgCfuGf uAfudTsdT | 1715 |
| 1104 | 1104-1122 | cuUfuGfgUfgCfcAfcCfuGfc GfuGfdTsdT | 1716 | CfAfcGfcAfgGfuGfgCfaCfcAf aAfgdTsdT | 1717 |
| 1106 | 1106-1124 | uuGfgUfgCfcAfcCfuGfcGfu GfaAfdTsdT | 1718 | UfUfcAfcGfcAfgGfuGfgCfaCf cAfadTsdT | 1719 |
| 1112 | 1112-1130 | ccAfcCfuGfcGfuGfaAfgAfa GfuGfdTsdT | 1720 | CfAfcUfuCfuUfcAfcGfcAfgGf uGfgdTsdT | 1721 |
| 1116 | 1116-1134 | cuGfcGfuGfaAfgAfaGfuGfu CfcCfdTsdT | 1722 | GfGfgAfcAfcUfuCfuUfcAfcGf cAfgdTsdT | 1723 |
| 1117 | 1117-1135 | ugCfgUfgAfaGfaAfgUfgUfc CfcCfdTsdT | 1724 | GfGfgGfaCfaCfuUfcUfuCfaCf gCfadTsdT | 1725 |
| 1118 | 1118-1136 | gcGfuGfaAfgAfaGfuGfuCfc CfcGfdTsdT | 1726 | CfGfgGfgAfcAfcUfuCfuUfcAf cGfcdTsdT | 1727 |
| 1119 | 1119-1137 | cgUfgAfaGfaAfgUfgUfcCfc CfgUfdTsdT | 1728 | AfCfgGfgGfaCfaCfuUfcUfuCf aCfgdTsdT | 1729 |
| 1120 | 1120-1138 | guGfaAfgAfaGfuGfuCfcCfc GfuAfdTsdT | 1730 | UfAfcGfgGfgAfcAfcUfuCfuUf cAfcdTsdT | 1731 |
| 1121 | 1121-1139 | ugAfaGfaAfgUfgUfcCfcCfg UfaAfdTsdT | 1732 | UfUfaCfgGfgGfaCfaCfuUfcUf uCfadTsdT | 1733 |
| 1122 | 1122-1140 | gaAfgAfaGfuGfuCfcCfcGfu AfaUfdTsdT | 1734 | AfUfuAfcGfgGfgAfcAfcUfuCf uUfcdTsdT | 1735 |
| 1123 | 1123-1141 | aaGfaAfgUfgUfcCfcCfgUfa AfuUfdTsdT | 1736 | AfAfuUfaCfgGfgGfaCfaCfuUf cUfudTsdT | 1737 |
| 1124 | 1124-1142 | agAfaGfuGfuCfcCfcGfuAfa UfuAfdTsdT | 1738 | UfAfaUfuAfcGfgGfgAfcAfcUf uCfudTsdT | 1739 |
| 1125 | 1125-1143 | gaAfgUfgUfcCfcCfgUfaAfu UfaUfdTsdT | 1740 | AfUfaAfuUfaCfgGfgGfaCfaCf uUfcdTsdT | 1741 |
| 1126 | 1126-1144 | aaGfuGfuCfcCfcGfuAfaUfu AfuGfdTsdT | 1742 | CfAfuAfaUfuAfcGfgGfgAfcAf cUfudTsdT | 1743 |
| 1127 | 1127-1145 | agUfgUfcCfcCfgUfaAfuUfa UfgUfdTsdT | 1744 | AfCfaUfaAfuUfaCfgGfgGfaCf aCfudTsdT | 1745 |

TABLE 6-continued

EGFR siRNA Sequences with Chemical Modifications

| hs Id # | Sequence position in NM_ 005228.3 | sense strand sequence (5'-3') | SEQ ID NO: | antisense strand sequence (5'-3') | SEQ ID NO: |
|---|---|---|---|---|---|
| 1128 | 1128-1146 | guGfuCfcCfcGfuAfaUfuAfuGfuGfdTsdT | 1746 | CfAfcAfuAfaUfaUfacGfgGfgAfcAfcdTsdT | 1747 |
| 1129 | 1129-1147 | ugUfcCfcCfgUfaAfuUfaUfgUfgGfdTsdT | 1748 | CfCfaCfaUfaAfuUfaCfgGfgGfaCfadTsdT | 1749 |
| 1130 | 1130-1148 | guCfcCfcGfuAfaUfAfuGfuGfgUfdTsdT | 1750 | AfCfcAfcAfuAfaUfuAfcGfgGfgAfcdTsdT | 1751 |
| 1132 | 1132-1150 | ccCfcGfuAfaUfuAfuGfuGfgUfgAfdTsdT | 1752 | UfCfaCfcAfcAfuAfaUfuAfcGfgGfgdTsdT | 1753 |
| 1134 | 1134-1152 | ccGfuAfaUfuAfuGfuGfgUfgAfcAfdTsdT | 1754 | UfGfuCfaCfcAfcAfuAfaUfuAfcGfgdTsdT | 1755 |
| 1136 | 1136-1154 | guAfaUfuAfuGfuGfgUfgAfcAfgAfdTsdT | 1756 | UfCfuGfuCfaCfcAfcAfuAfaUfuAfcdTsdT | 1757 |
| 1137 | 1137-1155 | uaAfuUfaUfgUfgGfuGfaCfaGfaUfdTsdT | 1758 | AfUfcUfgUfcAfcCfaCfaUfaAfuUfadTsdT | 1759 |
| 1138 | 1138-1156 | aaUfuAfuGfuGfgUfgAfcAfgAfuCfdTsdT | 1760 | GfAfuCfuGfuCfaCfcAfcAfuAfaUfudTsdT | 1761 |
| 1139 | 1139-1157 | auUfaUfgUfgGfuGfaCfaGfaUfcAfdTsdT | 1762 | UfGfaUfcUfgUfcAfcCfaCfaUfaAfudTsdT | 1763 |
| 1140 | 1140-1158 | uuAfuGfuGfgUfgAfcAfgAfuCfaCfdTsdT | 1764 | GfUfgAfuCfuGfuCfaCfcAfcAfuAfadTsdT | 1765 |
| 1142 | 1142-1160 | auGfuGfgUfgAfcAfgAfuCfaCfgGfdTsdT | 1766 | CfCfgUfgAfuCfuGfuCfaCfcAfcAfudTsdT | 1767 |
| 1145 | 1145-1163 | ugGfuGfaCfaGfaUfcAfcGfgCfuCfdTsdT | 1768 | GfAfgCfcGfuGfaUfcUfgUfcAfcCfadTsdT | 1769 |
| 1147 | 1147-1165 | guGfaCfaGfaUfcAfcGfgCfufgUfdTsdT | 1770 | AfCfgAfgCfcGfuGfaUfcUfgUfcAfcdTsdT | 1771 |
| 1148 | 1148-1166 | ugAfcAfgAfuCfaCfgGfcUfcGfuGfdTsdT | 1772 | CfAfcGfaGfcCfgUfgAfuCfuGfuCfadTsdT | 1773 |
| 1149 | 1149-1167 | gaCfaGfaUfcAfcGfgCfuCfgUfgCfdTsdT | 1774 | GfCfaCfgAfgCfcGfuGfaUfcUfgUfcdTsdT | 1775 |
| 1150 | 1150-1168 | acAfgAfuCfaCfgGfcUfcGfuGfcGfdTsdT | 1776 | CfGfcAfcGfaGfcCfgUfgAfuCfuGfudTsdT | 1777 |
| 1151 | 1151-1169 | caGfaUfcAfcGfgCfuCfgUfgCfgUfdTsdT | 1778 | AfCfgCfaCfgAfgCfcGfuGfaUfcUfgdTsdT | 1779 |
| 1152 | 1152-1170 | agAfuCfaCfgGfcUfcGfuGfcGfuCfdTsdT | 1780 | GfAfcGfcAfcGfaGfcCfgUfgAfuCfudTsdT | 1781 |
| 1153 | 1153-1171 | gaUfcAfcGfgCfuCfgUfgCfgUfcCfdTsdT | 1782 | GfGfaCfgCfaCfgAfgCfcGfuGfaUfcdTsdT | 1783 |
| 1154 | 1154-1172 | auCfaCfgGfcUfcGfuGfcGfuCfcGfdTsdT | 1784 | CfGfgAfcGfcAfcGfaGfcCfgUfgAfudTsdT | 1785 |
| 1155 | 1155-1173 | ucAfcGfgCfuCfgUfgCfgUfcCfgAfdTsdT | 1786 | UfCfgGfaCfgCfaCfgAfgCfcGfuGfadTsdT | 1787 |
| 1156 | 1156-1174 | caCfgGfcUfcGfuGfcGfuCfcGfaGfdTsdT | 1788 | CfUfcGfgAfcGfcAfcGfaGfcCfgUfgdTsdT | 1789 |
| 1157 | 1157-1175 | acGfgCfuCfgUfgCfgUfcCfgAfgCfdTsdT | 1790 | GfCfuCfgGfaCfgCfaCfgAfgCfcGfudTsdT | 1791 |
| 1160 | 1160-1178 | gcUfcGfuGfcGfuCfcGfaGfcCfuGfdTsdT | 1792 | CfAfgGfcUfcGfgAfcGfcAfcGfaGfcdTsdT | 1793 |

TABLE 6-continued

EGFR siRNA Sequences with Chemical Modifications

| hs Id # | Sequence position in NM_005228.3 | sense strand sequence (5'-3') | SEQ ID NO: | antisense strand sequence (5'-3') | SEQ ID NO: |
|---|---|---|---|---|---|
| 1200 | 1200-1218 | ggAfgGfaAfgAfcGfgCfgUfc fgCfdTsdT | 1794 | GfCfgGfaCfgCfcGfuCfuUfcCf uCfcdTsdT | 1795 |
| 1201 | 1201-1219 | gaGfgAfaGfaCfgGfcGfuCfc GfcAfdTsdT | 1796 | UfGfcGfgAfcGfcCfgUfcUfuCf cUfcdTsdT | 1797 |
| 1203 | 1203-1221 | ggAfaGfaCfgGfcGfuCfcGfc AfaGfdTsdT | 1798 | CfUfuGfcGfgAfcGfcCfgUfcUf uCfcdTsdT | 1799 |
| 1204 | 1204-1222 | gaAfgAfcGfgCfgUfcCfgCfa AfgUfdTsdT | 1800 | AfCfuUfgCfgGfaCfgCfcGfuCf uUfcdTsdT | 1801 |
| 1205 | 1205-1223 | aaGfaCfgGfcGfuCfcGfcAfa GfuGfdTsdT | 1802 | CfAfcUfuGfcGfgAfcGfcCfgUf cUfudTsdT | 1803 |
| 1207 | 1207-1225 | gaCfgGfcGfuCfcGfcAfaGfu GfuAfdTsdT | 1804 | UfAfcAfcUfuGfcGfgAfcGfcCf gUfcdTsdT | 1805 |
| 1208 | 1208-1226 | acGfgCfgUfcCfgCfaAfgUfg UfaAfdTsdT | 1806 | UfUfaCfaCfuUfgCfgGfaCfgCf cGfudTsdT | 1807 |
| 1211 | 1211-1229 | gcGfuCfcGfcAfaGfuGfuAfa GfaAfdTsdT | 1808 | UfUfcUfuAfcAfcUfuGfcGfgAf cGfcdTsdT | 1809 |
| 1212 | 1212-1230 | cgUfcCfgCfaAfgUfgUfaAfg AfaGfdTsdT | 1810 | CfUfuCfuUfaCfaCfuUfgCfgGf aCfgdTsdT | 1811 |
| 1213 | 1213-1231 | guCfcGfcAfaGfuGfuAfaGfa AfgUfdTsdT | 1812 | AfCfuUfcUfuAfcAfcUfuGfcGf gAfcdTsdT | 1813 |
| 1214 | 1214-1232 | ucCfgCfaAfgUfgUfaAfgAfa GfuGfdTsdT | 1814 | CfAfcUfuCfuUfaCfaCfuUfgCf gGfadTsdT | 1815 |
| 1215 | 1215-1233 | ccGfcAfaGfuGfuAfaGfaAfg UfgCfdTsdT | 1816 | GfCfaCfuUfcUfuAfcAfcUfuGf cGfgdTsdT | 1817 |
| 1216 | 1216-1234 | cgCfaAfgUfgUfaAfgAfaGfu GfcGfdTsdT | 1818 | CfGfcAfcUfuCfuUfaCfaCfuUf gCfgdTsdT | 1819 |
| 1217 | 1217-1235 | gcAfaGfuGfuAfaGfaAfgUfg CfgAfdTsdT | 1820 | UfCfgCfaCfuUfcUfuAfcAfcUf uGfcdTsdT | 1821 |
| 1219 | 1219-1237 | aaGfuGfuAfaGfaAfgUfgCfg AfaGfdTsdT | 1822 | CfUfuCfgCfaCfuUfcUfuAfcAf cUfudTsdT | 1823 |
| 1220 | 1220-1238 | agUfgUfaAfgAfaGfuGfcGfa AfgGfdTsdT | 1824 | CfCfuUfcGfcAfcUfuCfuUfaCf aCfudTsdT | 1825 |
| 1221 | 1221-1239 | guGfuAfaGfaAfgUfgCfgAfa GfgGfdTsdT | 1826 | CfCfcUfuCfgCfaCfuUfcUfuAf cAfcdTsdT | 1827 |
| 1222 | 1222-1240 | ugUfaAfgAfaGfuGfcGfaAfg GfgCfdTsdT | 1828 | GfCfcCfuUfcGfcAfcUfuCfuUf aCfadTsdT | 1829 |
| 1223 | 1223-1241 | guAfaGfaAfgUfgCfgAfaGfg GfcCfdTsdT | 1830 | GfGfcCfcUfuCfgCfaCfuUfcUf uAfcdTsdT | 1831 |
| 1224 | 1224-1242 | uaAfgAfaGfuUfgCfgAfaGfg GfcUfdTsdT | 1832 | AfGfgCfcCfuUfcGfcAfcUfuCf uUfadTsdT | 1833 |
| 1225 | 1225-1243 | aaGfaAfgUfgCfgAfaGfgGfc CfuUfdTsdT | 1834 | AfAfgGfcCfcUfuCfgCfaCfuUf cUfudTsdT | 1835 |
| 1226 | 1226-1244 | agAfaGfuGfcGfaAfgGfgCfc UfuGfdTsdT | 1836 | CfAfaGfgCfcCfuUfcGfcAfcUf uCfudTsdT | 1837 |
| 1229 | 1229-1247 | agUfgCfgAfaGfgGfcCfuUfg CfcGfdTsdT | 1838 | CfGfgCfaAfgGfcCfcUfuCfgCf aCfudTsdT | 1839 |
| 1230 | 1230-1248 | guGfcGfaAfgGfgCfcUfuGfc CfgGfdTsdT | 1840 | GfCfgGfcAfaGfgCfcCfuUfcGf cAfcdTsdT | 1841 |

TABLE 6-continued

EGFR siRNA Sequences with Chemical Modifications

| hs Id # | Sequence position in NM_ 005228.3 | sense strand sequence (5'-3') | SEQ ID NO: | antisense strand sequence (5'-3') | SEQ ID NO: |
|---|---|---|---|---|---|
| 1231 | 1231-1249 | ugCfgAfaGfgGfcCfuUfgCfcGfcAfdTsdT | 1842 | UfGfcGfgCfaAfgGfcCfcUfuCfgCfadTsdT | 1843 |
| 1232 | 1232-1250 | gcGfaAfgGfgCfcUfuGfcCfgfaAfdTsDT | 1844 | UfUfgCfgGfcAfaGfcCfcUfuUfcGfcdTsdT | 1845 |
| 1233 | 1233-1251 | cgAfaGfgGfcCfuUfgCfcGfcAfaAfdTsdT | 1846 | UfUfuGfcGfgCfaAfgGfcCfcUfuCfgdTsdT | 1847 |
| 1235 | 1235-1253 | aaGfgGfcCfuUfgCfcGfcAfaAfgUfdTsdT | 1848 | AfCfuUfuGfcGfgCfaAfgGfcCfcUfudTsdT | 1849 |
| 1236 | 1236-1254 | agGfgCfcUfuGfcCfgCfaAfaGfuGfdTsdT | 1850 | CfAfcUfuUfgCfgGfcAfaGfgCfcCfudTsdT | 1851 |
| 1237 | 1237-1255 | ggGfcCfuUfgCfcGfcAfaAfgUfgUfdTsdT | 1852 | AfCfaCfuUfuGfcGfgCfaAfgGfcCfcdTsdT | 1853 |
| 1238 | 1238-1256 | ggCfcUfuGfcCfgCfaAfaGfuGfuGfdTsdT | 1854 | CfAfcAfcUfuUfgCfgGfcAfaGfgCfcdTsdT | 1855 |
| 1239 | 1239-1257 | gcCfuUfgCfcGfcAfaAfgUfgUfgUfdTsdT | 1856 | AfCfaCfaCfuUfuGfcGfgCfaAfgGfcdTsdT | 1857 |
| 1241 | 1241-1259 | cuUfgCfcGfcAfaAfgUfgUfgUfaAfdTsdT | 1858 | UfUfaCfaCfaCfuUfuGfcGfgCfaAfgdTsdT | 1859 |
| 1261 | 1261-1279 | ggAfaUfaGfgUfaUfuGfgUfgAfaUfdTsdT | 1860 | AfUfuCfaCfcAfaUfaCfcUfaUfuCfcdTsdT | 1861 |
| 1262 | 1262-1280 | gaAfuAfgGfuAfuUfgGfuGfaAfuUfdTsdT | 1862 | AfAfuUfcAfcCfaAfuAfcCfuAfuUfcdTsdT | 1863 |
| 1263 | 1263-1281 | aaUfaGfgUfaUfuGfgUfgAfaUfuUfdTsdT | 1864 | AfAfaUfuCfaCfcAfaUfaCfcUfaUfudTsdT | 1865 |
| 1264 | 1264-1282 | auAfgGfuAfuUfgGfuGfaAfuUfaAfdTsdT | 1866 | UfAfaAfuUfcAfcCfaAfuAfcCfuAfudTsdT | 1867 |
| 1266 | 1266-1284 | agGfuAfuUfgGfuGfaAfuUfuAfaAfdTsdT | 1868 | UfUfuAfaAfuUfcAfcCfaAfuAfcCfudTsdT | 1869 |
| 1267 | 1267-1285 | ggUfaUfuGfgUfgAfaUfuUfaAfaGfdTsdT | 1870 | CfUfuUfaAfaUfuCfaCfcAfuAfcdTsdT | 1871 |
| 1289 | 1289-1307 | caCfuCfuCfcAfuAfaAfuGfcUfaCfdTsdT | 1872 | GfUfaGfcAfuUfuAfuGfgAfgfgUfgdTsdT | 1873 |
| 1313 | 1313-1331 | uuAfaAfcAfcUfuCfaAfaAfaCfuGfdTsdT | 1874 | CfAfgUfuUfuUfgAfaGfuGfuUfuAfadTsdT | 1875 |
| 1320 | 1320-1338 | cuUfcAfaAfaAfcUfgCfaCfcUfcCfdTsdT | 1876 | GfGfaGfgUfgCfaGfuUfuUfuGfaAfgdTsdT | 1877 |
| 1321 | 1321-1339 | uuCfaAfaAfaCfuGfcAfcCfuCfcAfdTsdT | 1878 | UfGfgAfgGfuGfcAfgUfuUfuUfgAfadTsdT | 1879 |
| 1322 | 1322-1340 | ucAfaAfaAfcUfgCfaCfcUfcCfaUfdTsdT | 1880 | AfUfgGfaGfgUfgCfaGfuUfuUfuGfadTsdT | 1881 |
| 1323 | 1323-1341 | caAfaAfaCfuGfcAfcCfuCfcAfuCfdTsdT | 1882 | GfAfuGfgAfgGfuGfcAfgUfuUfuUfdTsdT | 1883 |
| 1324 | 1324-1342 | aaAfaAfcUfgCfaCfcUfcCfaUfcAfdTsdT | 1884 | UfGfaUfgGfaGfgUfgCfaGfuUfuUfudTsdT | 1885 |
| 1328 | 1328-1346 | acUfgCfaCfcUfcCfaUfcAfgUfgGfdTsdT | 1886 | CfCfaCfuGfaUfgGfaGfgUfgCfaGfudTsdT | 1887 |
| 1332 | 1332-1350 | caCfcUfcCfaUfcAfgUfgGfcGfaUfdTsdT | 1888 | AfUfcGfcCfaCfuGfaUfgGfaGfgUfgdTsdT | 1889 |

TABLE 6-continued

EGFR siRNA Sequences with Chemical Modifications

| hs Id # | Sequence position in NM_005228.3 | sense strand sequence (5'-3') | SEQ ID NO: | antisense strand sequence (5'-3') | SEQ ID NO: |
|---|---|---|---|---|---|
| 1333 | 1333-1351 | acCfuCfcAfuCfaGfuGfcCfg AfuCfdTsdT | 1890 | GfAfuCfgCfcAfcUfgAfuGfgAf gGfudTsdT | 1891 |
| 1335 | 1335-1353 | cuCfcAfuCfaGfuGfcGfaFfu CfuCfdTsdT | 1892 | GfAfgAfuCfgCfcAfcUfgAfuGf gAfgdTsdT | 1893 |
| 1338 | 1338-1356 | caUfcAfgUfgGfcGfaUfcUfc faCfdTsdT | 1894 | GfUfgGfaGfaUfcGfcCfaCfuGf aUfgdTsdT | 1895 |
| 1344 | 1344-1362 | ugGfcGfaUfcUfcCfaCfaUfcC fuGfdTsdT | 1896 | CfAfgGfaUfgUfgGfaGfaUfcGf cCfadTsdT | 1897 |
| 1345 | 1345-1363 | ggCfgAfuCfuCfcAfcAfuCfc UfgCfdTsdT | 1898 | GfCfaGfgAfuGfuGfgAfgAfuCf gCfcdTsdT | 1899 |
| 1346 | 1346-1364 | gcGfaUfcUfcCfaCfaUfcCfuG fcCfdTsdT | 1900 | GfGfcAfgGfaUfgUfgGfaGfaUf cGfcdTsdT | 1901 |
| 1347 | 1347-1365 | cgAfuCfuCfcAfcAfuCfcUfg CfcGfdTsdT | 1902 | CfGfgCfaGfgAfuGfuGfgAfgAf uCfgdTsdT | 1903 |
| 1348 | 1348-1366 | gaUfcUfcCfaCfaUfcCfuGfcC fgGfdTsdT | 1904 | CfCfgGfcAfgGfaUfgUfgGfaGf aUfcdTsdT | 1905 |
| 1353 | 1353-1371 | ccAfcAfuCfcUfgCfcGfgUfg GfcAfdTsdT | 1906 | UfGfcCfaCfcGfgCfaGfgAfuGf uGfgdTsdT | 1907 |
| 1354 | 1354-1372 | caCfaUfcCfuGfcCfgGfuGfg CfaUfdTsdT | 1908 | AfUfgCfcAfcCfgGfcAfgGfaUf gUfgdTsdT | 1909 |
| 1355 | 1355-1373 | acAfuCfcUfgCfcGfgUfgGfc AfuUfdTsdT | 1910 | AfAfuGfcCfaCfcGfgCfaGfgAf uGfudTsdT | 1911 |
| 1357 | 1357-1375 | auCfcUfgCfcGfgUfgGfcAfu UfuAfdTsdT | 1912 | UfAfaAfuGfcCfaCfcGfgCfaGf gAfudTsdT | 1913 |
| 1360 | 1360-1378 | cuGfcCfgGfuGfgCfaUfuUfa GfgGfdTsdT | 1914 | CfCfcUfaAfaUfgCfcAfcCfgGf cAfgdTsdT | 1915 |
| 1361 | 1361-1379 | ugCfcGfgUfgGfcAfuUfuAfg GfgGfdTsdT | 1916 | CfCfcCfuAfaAfuGfcCfaCfcGf gCfadTsdT | 1917 |
| 1362 | 1362-1380 | gcCfgGfuGfgCfaUfuUfaGfg GfgUfdTsdT | 1918 | AfCfcCfcUfaAfaUfgCfcAfcCf gGfcdTsdT | 1919 |
| 1363 | 1363-1381 | ccGfgUfgGfcAfuUfuAfgGfg GfuGfdTsdT | 1920 | CfAfcCfcCfuAfaAfuGfcCfaCf cGfgdTsdT | 1921 |
| 1366 | 1366-1384 | guGfgCfaUfuUfaGfgGfgUfg AfcUfdTsdT | 1922 | AfGfuCfaCfcCfcUfaAfaUfgCf cAfcdTsdT | 1923 |
| 1369 | 1369-1387 | gcAfuUfuAfgGfgGfuGfaCfu CfcUfdTsdT | 1924 | AfGfgAfgUfcAfcCfcCfuAfaAf uGfcdTsdT | 1925 |
| 1370 | 1370-1388 | caUfuUfaGfgGfgUfgAfcUfc CfuUfdTsdT | 1926 | AfAfgGfaGfuCfaCfcCfcUfaAf aUfgdTsdT | 1927 |
| 1371 | 1371-1389 | auUfuAfgGfgGfuGfaCfuCfc UfuCfdTsdT | 1928 | GfAfaGfgAfgUfcAfcCfcCfuAf aAfudTsdT | 1929 |
| 1372 | 1372-1390 | uuUfaGfgGfgUfgAfcUfcCfu UfcAfdTsdT | 1930 | UfGfaAfgGfaGfuCfaCfcCfcUf aAfadTsdT | 1931 |
| 1373 | 1373-1391 | uuAfgGfgGfuGfaCfuCfcUfu CfaCfdTsdT | 1932 | GfUfgAfaGfgAfgUfcAfcCfcCf uAfadTsdT | 1933 |
| 1374 | 1374-1392 | uaGfgGfgUfgAfcUfcCfuUfc AfcAfdTsdT | 1934 | UfGfuGfaAfgGfaGfuCfaCfcCf cUfadTsdT | 1935 |
| 1404 | 1404-1422 | ucUfgGfaUfcCfaCfaGfgAfa CfuGfdTsdT | 1936 | CfAfgUfuCfcUfgUfgGfaUfcCf aGfadTsdT | 1937 |

TABLE 6-continued

EGFR siRNA Sequences with Chemical Modifications

| hs Id # | Sequence position in NM_ 005228.3 | sense strand sequence (5'-3') | SEQ ID NO: | antisense strand sequence (5'-3') | SEQ ID NO: |
|---|---|---|---|---|---|
| 1408 | 1408-1426 | gaUfcCfaCfaGfgAfaCfuGfgAfuAfdTsdT | 1938 | UfAfuCfcAfgUfuCfcUfgUfgGfaUfcdTsdT | 1939 |
| 1409 | 1409-1427 | auCfcAfcAfgGfaAfcUfgGfaUfaUfdTsdT | 1940 | AfUfaUfcCfaGfuUfcCfuGfuGfgAfudTsdT | 1941 |
| 1411 | 1411-1429 | ccAfcAfgGfaAfcUfgGfaUfaUfuCfdTsdT | 1942 | GfAfaUfaUfcCfaGfuUfcCfuGfuGfgdTsdT | 1943 |
| 1412 | 1412-1430 | caCfaGfgAfaCfuGfgAfuAfuUfcUfdTsdT | 1944 | AfGfaAfuAfuCfcAfgUfuCfcUfgUfgdTsdT | 1945 |
| 1419 | 1419-1437 | acUfgGfaUfaUfuCfuGfaAfaAfcCfdTsdT | 1946 | GfGfuUfuUfcAfgAfaUfaUfcCfaGfudTsdT | 1947 |
| 1426 | 1426-1444 | auUfcUfgAfaAfaCfcGfuAfaAfgGfdTsdT | 1948 | CfCfuUfuAfcGfgUfuUfuCfaGfaAfudTsdT | 1949 |
| 1427 | 1427-1445 | uuCfuGfaAfaAfcCfgUfaAfaGfgAfdTsdT | 1950 | UfCfcUfuUfaCfgGfuUfuUfcAfgAfadTsdT | 1951 |
| 1430 | 1430-1448 | ugAfaAfaCfcGfuAfaAfgGfaAfaUfdTsdT | 1952 | AfUfuUfcCfuUfuAfcGfgUfuUfuCfadTsdT | 1953 |
| 1431 | 1431-1449 | gaAfaAfcCfgUfaAfaGfgAfaAfuCfdTsdT | 1954 | GfAfuUfuCfcUfuUfaCfgGfuUfuUfcdTsdT | 1955 | siRNA Sequence with Chemical Modification Info
lower case (n) = 2'O-Me; Nf = 2'-F; dT = deoxy-T residue;
s = phosphorothioate backbone modification; iB = inverted abasic

TABLE 7

AR Target Sequences

| ID | Code | Target Sequence | SEQ ID NO: | NM_000044.3 | Exon | Species |
|---|---|---|---|---|---|---|
| XD-018171C1 | 17 | CAAAGGUUCUCUGCUAGACGACA | 1956 | 1987-2005 | 1 | h |
| XD-018271C1 | 27 | UCUGGGUGUCACUAUGGAGCUCU | 1957 | 2819-2837 | 2 | h |
| XD-018281C1 | 28 | CUGGGUGUCACUAUGGAGCUCUC | 1958 | 2820-2838 | 2 | h |
| XD-018291C1 | 29 | GGGUGUCACUAUGGAGCUCUCAC | 1959 | 2822-2840 | 2 | h |
| XD-01821K1 | 21 | UACUACAACUUUCCACUGGCUCU | 1960 | 2207-2225 | 1 | h |
| XD-01825K1 | 25 | AAGCUUCUGGGUGUCACUAUGGA | 1961 | 2814-2832 | 2 | h, m |
| XD-01826K1 | 26 | CUUCUGGGUGUCACUAUGGAGCU | 1962 | 2817-2835 | 2 | h |

TABLE 8

β-catenin Target Sequences

| R # | Generic name | Gene | Target sequences | | | |
|---|---|---|---|---|---|---|
| R-1146 | 1797mfm | CTNNB1 | CUGUUGGAUUGAUUCGAAAUU | SEQ ID NO: 1963 | UUUCGAAUCAAUCCAACAGUU | SEQ ID NO: 1964 |
| R-1147 | 1870mfm | CTNNB1 | ACGACUAGUUCAGUUGCUUUU | SEQ ID NO: 1965 | AAGCAACUGAACUAGUCGUUU | SEQ ID NO: 1966 |

TABLE 9

β-catenin and β-catenin associated siRNA Sequences

| R # | Generic name | Gene | Sense Strand Sequence (5'-3') Passenger Strand (PS)2 | SEQ ID NO: | Antisense Strand Sequence (5'-3') Guide Strand (GS)3 | SEQ ID NO: |
|---|---|---|---|---|---|---|
| R-1146 | 1797mfm | CTNNB1 | iBcsuGfuUfgGfaUfuGfaUfuCfgAfaAfusuiB | 1967 | usUfsusCfgAfaUfcAfaUfcCfaAfcAfgusu | 1968 |
| R-1147 | 1870mfm | CTNNB1 | iBascGfaCfuAfgUfuCfaGfuUfgCfuUfusuiB | 1969 | asAfsgsCfaAfcUfgAfaCfuAfgUfcGfuusu | 1970 |
| R-1150 | PA1746 | 1746 | GCUCAAAGCAAUUUCUACAdTsdT | 1971 | UGUAGAAAUUGCUUUGAGCdTsdT | 1972 |
| R-1151 | PA2328 | 2328 | GGAUGAAACACAAAAGGUAdTsdT | 1973 | UACCUUUUGUGUUUCAUCCdTsdT | 1974 |
| R-1152 | PA2522 | 2522 | UGUCAGAGUUACUGUUUCAdTsdT | 1975 | UGAAACAGUAACUCUGACAdTsdT | 1976 |
| R-1153 | PA3484 | 3484 | AGCAAGAACAGAAAUAAAAdTsdT | 1977 | UUUUAUUUCUGUUCUUGCUdTsdT | 1978 |
| R-1154 | PA5018 | 5018 | CUAGUUCAUUUCAAAAUUAdTsdT | 1979 | UAAUUUUGAAAUGAACUAGdTsdT | 1980 |
| R-1155 | PB183 | 183 | CAAGUUCACAAUUACCCAAdTsdT | 1981 | UUGGGUAAUUGUGAACUUGdTsdT | 1982 |
| R-1156 | PB272 | 272 | GCUUGAAGAUGAAACACGAdTsdT | 1983 | UCGUGUUUCAUCUUCAAGCdTsdT | 1984 |
| R-1157 | PB862 | 862 | AGAUCAAGAAAAUGUAUGAdTsdT | 1985 | UCAUACAUUUUCUUGAUCUdTsdT | 1986 |
| R-1158 | PB948 | 948 | CCAAAGAAAACACGAAUUAdTsdT | 1987 | UAAUUCGUGUUUUCUUUGGdTsdT | 1988 |
| R-1159 | PB1520 | 1520 | CUUCGAUAAGAUUAUUGAAdTsdT | 1989 | UUCAAUAAUCUUAUCGAAGdTsdT | 1990 |
| R-1160 | Myc953U | 953 | AGGAACUAUGACCUCGACUdTsdT | 1991 | AGUCGAGGUCAUAGUUCCUdTsdT | 1992 |
| R-1161 | Myc622U | 622 | ACGACGAGACCUUCAUCAAdTsdT | 1993 | UUGAUGAAGGUCUCGUCGUdTsdT | 1994 |
| R-1162 | Myc1370U | 1370 | AAGAUGAGGAAGAAAUCGAdTsdT | 1995 | UCGAUUUCUUCCUCAUCUUdTsdT | 1996 |
| R-1163 | Myc1364U | 1364 | AGGAAGAAAUCGAUGUUGUdTsdT | 1997 | ACAACAUCGAUUUCUUCCUdTsdT | 1998 |
| R-1164 | Myc1711U | 1711 | AGCUUUUUUGCCCUGCGUGdTsdT | 1999 | CACGCAGGGCAAAAAAGCUdTsdT | 2000 |
| R-1165 | Myc1769U | 1769 | AGGUAGUUAUCCUUAAAAdTsdT | 2001 | UUUUUAAGGAUAACUACCUdTsdT | 2002 | siRNA Sequence with Chemical Modification Info
lower case (n) = 2'-O-Me; Nf = 2'-F; dT = deoxy-T residue;
s = phosphorothioate backbone modification; iB = inverted abasic

TABLE 10

PIK3CA* and PIK3CB* Target Sequences

| Gene Symbol | Gene ID | Name | Target Sequences (97-mer) | SEQ ID NO: |
|---|---|---|---|---|
| PIK3CA | 5290 | PIK3CA_1746 | TGCTGTTGACAGTGAGCGCCAGCTCAAAGCAATTT CTACATAGTGAAGCCACAGATGTATGTAGAAATTG CTTTGAGCTGTTGCCTACTGCCTCGGA | 2003 |
| PIK3CA | 5290 | PIK3CA_2328 | TGCTGTTGACAGTGAGCGAAAGGATGAAACACAAA AGGTATAGTGAAGCCACAGATGTATACCTTTTGTGT TTCATCCTTCTGCCTACTGCCTCGGA | 2004 |
| PIK3CA | 5290 | PIK3CA_2522 | TGCTGTTGACAGTGAGCGCCATGTCAGAGTTACTGT TTCATAGTGAAGCCACAGATGTATGAAACAGTAAC TCTGACATGATGCCTACTGCCTCGGA | 2005 |
| PIK3CA | 5290 | PIK3CA_3555 | TGCTGTTGACAGTGAGCGCAACTAGTTCATTTCAAA ATTATAGTGAAGCCACAGATGTATAATTTTGAAAT GAACTAGTTTTGCCTACTGCCTCGGA | 2006 |
| PIK3CA | 5290 | PIK3CA_3484 | TGCTGTTGACAGTGAGCGCACAGCAAGAACAGAAA TAAAATAGTGAAGCCACAGATGTATTTTATTTCTGT TCTTGCTGTATGCCTACTGCCTCGGA | 2007 |
| PIK3CB | 5291 | PIK3CB_862 | TGCTGTTGACAGTGAGCGACAAGATCAAGAAAATG TATGATAGTGAAGCCACAGATGTATCATACATTTTC TTGATCTTGCTGCCTACTGCCTCGGA | 2008 |
| PIK3CB | 5291 | PIK3CB_183 | TGCTGTTGACAGTGAGCGCAGCAAGTTCACAATTA CCCAATAGTGAAGCCACAGATGTATTGGGTAATTG TGAACTTGCTTTGCCTACTGCCTCGGA | 2009 |
| PIK3CB | 5291 | PIK3CB_1520 | TGCTGTTGACAGTGAGCGCCCCTTCGATAAGATTAT TGAATAGTGAAGCCACAGATGTATTCAATAATCTT ATCGAAGGGATGCCTACTGCCTCGGA | 2010 |
| PIK3CB | 5291 | PIK3CB_272 | TGCTGTTGACAGTGAGCGAGAGCTTGAAGATGAAA CACGATAGTGAAGCCACAGATGTATCGTGTTTCATC TTCAAGCTCCTGCCTACTGCCTCGGA | 2011 |
| PIK3CB | 5291 | PIK3CB_948 | TGCTGTTGACAGTGAGCGACACCAAAGAAAACACG AATTATAGTGAAGCCACAGATGTATAATTCGTGTTT TCTTTGGTGGTGCCTACTGCCTCGGA | 2012 |

*Species is *Homo sapiens*.

TABLE 11

PIK3CA and PIK3CB siRNA Sequences

| Gene Symbol | Gene ID | Name | siRNA Guide | SEQ ID NO: | siRNA passenger | SEQ ID NO: |
|---|---|---|---|---|---|---|
| PIK3CA | 5290 | PIK3CA_1746 | UGUAGAAAUUGCUU UGAGCUGU | 2013 | AGCUCAAAGCAAUUU CUACAUA | 2014 |
| PIK3CA | 5290 | PIK3CA_2328 | UACCUUUUGUGUUU CAUCCUUC | 2015 | AGGAUGAAACACAAA AGGUAUA | 2016 |
| PIK3CA | 5290 | PIK3CA_2522 | UGAAACAGUAACUC UGACAUGA | 2017 | AUGUCAGAGUUACUG UUUCAUA | 2018 |
| PIK3CA | 5290 | PIK3CA_3555 | UAAUUUUGAAAUGA ACUAGUUU | 2019 | ACUAGUUCAUUUCAA AAUUAUA | 2020 |
| PIK3CA | 5290 | PIK3CA_3484 | UUUUAUUUCUGUUC UUGCUGUA | 2021 | CAGCAAGAACAGAAA UAAAAUA | 2022 |
| PIK3CB | 5291 | PIK3CB_862 | UCAUACAUUUUCUU GAUCUUGC | 2023 | AAGAUCAAGAAAAUG UAUGAUA | 2024 |
| PIK3CB | 5291 | PIK3CB_183 | UUGGGUAAUUGUGA ACUUGCUU | 2025 | GCAAGUUCACAAUUA CCCAAUA | 2026 |

TABLE 11-continued

PIK3CA and PIK3CB siRNA Sequences

| Gene Symbol | Gene ID | Name | siRNA Guide | SEQ ID NO: | siRNA passenger | SEQ ID NO: |
|---|---|---|---|---|---|---|
| PIK3CB | 5291 | PIK3CB_1520 | UUCAAUAAUCUUAUCGAAGGGA | 2027 | CCUUCGAUAAGAUUAUUGAAUA | 2028 |
| PIK3CB | 5291 | PIK3CB_272 | UCGUGUUUCAUCUUCAAGCUCC | 2029 | AGCUUGAAGAUGAAACACGAUA | 2030 |
| PIK3CB | 5291 | PIK3CB_948 | UAAUUCGUGUUUUCUUUGGUGG | 2031 | ACCAAAGAAAACACGAAUUAUA | 2032 |

TABLE 12

Additional polynucleic acid molecule sequences

| | Base start position | Guide strand | SEQ ID NO: | Passenger strand | SEQ ID NO: |
|---|---|---|---|---|---|
| EGFR R1246 | 333 | ACUCGUGCCUUGGCAAACUUU | 2082 | AGUUUGCCAAGGCACGAGUUU | 2083 |
| EGFR R1195 | 333 | ACUCGUGCCUUGGCAAACUUU | 2084 | AGUUUGCCAAGGCACGAGUUU | 2085 |
| EGFR R1449 | 333 | ACUCGUGCCUUGGCAAACUUU | 2086 | AGUUUGCCAAGGCACGAGUUU | 2087 |
| KRAS R1450 | 237 | UGAAUUAGCUGUAUCGUCAUU | 2088 | TGACGAUACAGCUAAUUCAUU | 2089 |
| KRAS R1443 | 237 | UGAAUUAGCUGUAUCGUCAUU | 2090 | UGACGAUACAGCUAAUUCAUU | 2091 |
| KRAS R1194 | 237 | UGAAUUAGCUGUAUCGUCAUU | 2092 | UGACGAUACAGCUAAUUCAUU | 2093 |
| CTNNB1 R1442 | 1248 | UAAGUAUAGGUCCUCAUUAUU | 2094 | UAAUGAGGACCUAUACUUAUU | 2095 |
| CTNNB1 R1404 | 1797 | TUUCGAAUCAAUCCAACAGUU | 2096 | CUGUUGGAUUGAUUCGAAAUU | 2097 |
| CTNNB1 R1441 | 1797 | UUUCGAAUCAAUCCAACAGUU | 2098 | CUGUUGGAUUGAUUCGAAAUU | 2099 |
| CTNNB1 R1523 | 1797 | UUUCGAAUCAAUCCAACAGUU | 2100 | CUGUUGGAUUGAUUCGAAAUU | 2101 |
| HPRT R1492 | 425 | AUAAAAUCUACAGUCAUAGUU | 2102 | CUAUGACUGUAGAUUUUAUUU | 2103 |
| HPRT R1526 | 425 | UUAAAAUCUACAGUCAUAGUU | 2104 | CUAUGACUGUAGAUUUUAAUU | 2105 |
| HPRT R1527 | 425 | UUAAAAUCUACAGUCAUAGUU | 2106 | CUAUGACUGUAGAUUUUAAUU | 2107 |
| AR R1245 | 2822 | GAGAGCUCCAUAGUGACACUU | 2108 | GUGUCACUAUGGAGCUCUCUU | 2109 |

Example 2. General Experimental Protocol

Stem-Loop qPCR Assay for Quantification of siRNA

Plasma samples were directly diluted in TE buffer. 50 mg tissue pieces were homogenized in 1 mL of Trizol using a FastPrep-24 tissue homogenizer (MP Biomedicals) and then diluted in TE buffer. Standard curves were generated by spiking siRNA into plasma or homogenized tissue from untreated animals and then serially diluting with TE buffer. The antisense strand of the siRNA was reverse transcribed using a TaqMan MicroRNA reverse transcription kit (Applied Biosystems) with 25 nM of a sequence-specific stem-loop RT primer. The cDNA from the RT step was utilized for real-time PCR using TaqMan Fast Advanced Master Mix (Applied Biosystems) with 1.5 µM of forward primer, 0.75 µM of reverse primer, and 0.2 µM of probe. The sequences of KRAS and EGFR siRNA antisense strands and all primers and probes used to measure them are shown in Table 13. Quantitative PCR reactions were performed using standard cycling conditions in a ViiA 7 Real-Time PCR System (Life Technologies). The Ct values were transformed into plasma or tissue concentrations using the linear equations derived from the standard curves.

TABLE 13

Sequences for all siRNA antisense strands, primers, and probes used in the stem-loop qPCR assay.

| Target | Name | Sequence (5'-3') | SEQ ID NO: |
|---|---|---|---|
| KRAS | Antisense | UGAAUUAGCUGUAUCGUCAUU | 2033 |
| KRAS | RT | GTCGTATCCAGTGCAGGGTCCGAGGTATTCGCACTGGATACGACAATGACG | 2034 |
| KRAS | Forward | GGCGGCTGAATTAGCTGTATCGT | 2035 |
| KRAS | Reverse | AGTGCAGGGTCCGAG | 2036 |
| KRAS | Probe | (6FAM)-TGGATACGACAATGAC-(NFQ-MGB) | 2037 |

| Target | Name | Sequence (5'-3') | |
|---|---|---|---|
| EGFR | Antisense | ACUCGUGCCUUGGCAAACUUU | 2038 |
| EGFR | RT | GTCGTATCCAGTGCAGGGTCCGAGGTATTCGCACTGGATACGACAAAGTTTG | 2039 |
| EGFR | Forward | GGCGGCACTCGTGCCTTGGCA | 2040 |
| EGFR | Reverse | AGTGCAGGGTCCGAG | 2041 |
| EGFR | Probe | (6FAM)-TGGATACGACAAAGTT-(NFQ-MGB) | 2042 |

Comparative qPCR Assay for Determination of mRNA Knockdown

Tissue samples were homogenized in Trizol as described above. Total RNA was isolated using RNeasy RNA isolation 96-well plates (Qiagen), then 500 ng RNA was reverse transcribed with a High Capacity RNA to cDNA kit (ThermoFisher). KRAS, EGFR, CTNNB1 and PPIB mRNA was quantified by TaqMan qPCR analysis performed with a ViiA 7 Real-Time PCR System. The TaqMan primers and probes for KRAS were designed and validated by Avidity and are shown in Table 14. The TaqMan primers and probes for EGFR and CTNNB1 were purchased from Applied Biosystems as pre-validated gene expression assays. PPIB (housekeeping gene) was used as an internal RNA loading control, with all TaqMan primers and probes for PPIB purchased from Applied Biosystems as pre-validated gene expression assays. Results are calculated by the comparative Ct method, where the difference between the target gene (KRAS, CTNNB1, or EGFR) Ct value and the PPIB Ct value (ΔCt) is calculated and then further normalized relative to the PBS control group by taking a second difference (ΔΔCt).

TABLE 14

Sequences of primers and probes for KRAS mRNA detection using comparative qPCR assay.

| Target | Species | Name | Sequence (5'-3') | SEQ ID NO: |
|---|---|---|---|---|
| KRAS | Mouse | Forward | CGCCTTGACGATACAGCTAAT | 2043 |
| KRAS | Mouse | Reverse | TGTTTCCTGTAGGAGTCCTCTAT | 2044 |
| KRAS | Mouse | Probe | (6FAM)-TCACTTTGT(Zen)GGATGAGTATGACCCTACG-(IABkFQ) | 2045 and 2114 |

| Target | Species | Name | Sequence (5'-3') | |
|---|---|---|---|---|
| KRAS | Human | Forward | GTGCCTTGACGATACAGCTAAT | 2046 |
| KRAS | Human | Reverse | CCAAGAGACAGGTTTCTCCATC | 2047 |

TABLE 14-continued

Sequences of primers and probes for KRAS mRNA detection using comparative qPCR assay.

| KRAS | Human | Probe | (6FAM)-CCAACAATA(Zen)GAGGATTCCTACAGGAAGCA-(IABkFQ) | 2048 and 2115 |

Animals

All animal studies were conducted following protocols in accordance with the Institutional Animal Care and Use Committee (IACUC) at Explora BioLabs, which adhere to the regulations outlined in the USDA Animal Welfare Act as well as the "Guide for the Care and Use of Laboratory Animals" (National Research Council publication, 8th Ed., revised in 2011). All mice were obtained from either Charles River Laboratories or Harlan Laboratories.

H358, HCC827, and Hep-3B2 1-7 Subcutaneous Flank Tumor Model

For the H358 subcutaneous flank tumor model, tumor cells were inoculated and tumors were established according to the following methods. Female NCr nu/nu mice were identified by ear-tag the day before cell injection. Mice were weighed prior to inoculation. H358 cells were cultured with 10% FBS/RPMI medium and harvested with 0.05% Trypsin and Cell Stripper (MediaTech). 5 million H358 cells in 0.05 ml Hank's Balanced Salt Solution (HBSS) with Matrigel (1:1) were injected subcutaneously (SC) into the upper right flank of each mouse. Tumor growth was monitored by tumor volume measurement using a digital caliper starting on day 7 after inoculation, and followed 2 times per week until average tumor volume reaches >100 & ≤300 $mm^3$. Once tumors were staged to the desired volume (average from 100 to 300 $mm^3$), animals were randomized and mice with very large or small tumors were culled. Mice were divided into the required groups and randomized by tumor volume. Mice were then treated as described in the individual experiments.

For the Hep3B orthotropic liver tumor model, tumor cells were inoculated and tumors were established according to the following methods. Female NCr nu/nu mice were identified by ear-tag the day before, mice will be anesthetized with isoflurane. The mice were then placed in a supine position on a water circulating heating pad to maintain body temperature. A small transverse incision below the sternum will be made to expose the liver. Cancer cells were slowly injected into the upper left lobe of the liver using a 28-gauge needle. The cells were injected at a 30-degree angle into the liver, so that a transparent bleb of cells can be seen through the liver capsule. Hep 3B2.1 7 cells were prepared by suspending in cold PBS (0.1-5×$10^6$ cells) and mixing with diluted matrigel (30× in PBS). 30-50 ul of the cell/matrigel was inoculated. After injection, a small piece of sterile gauze was placed on the injection site, and light pressure was applied for 1 min to prevent bleeding. The abdomen was then closed with a 6-0 silk suture. After tumor cell implantation, animals were kept in a warm cage, observed for 1-2 h, and subsequently returned to the animal room after full recovery from the anesthesia. 7-10 days after tumor implantation animals were randomized, divided into the required groups and then treated as described in the individual experiments.

LNCap Subcutaneous Flank Tumor Model

LNCaP cells (ATCC® CRL-1740™) were grown in RPMI+10% FBS supplemented with non-essential amino acids and sodium pyruvate to a confluency of about 80%. Cells were mixed 1:1 with matrigel and 5-7*106 cells injected subcutaneously into male SCID mice (6-8 weeks). Tumors usually developed within 3-5 weeks to a size of 100-350 $mm^3$. Animals bearing tumors within this range were randomized and treated with ASCs by injections into the tail vein. For PD studies animals were sacrificed 96 hours after injection and organ fragments harvested, weighted, and frozen in liquid nitrogen. For RNA isolation, organ samples were homogenized in Trizol and RNA prepared using a Qiagen RNeasy 96 Plus kit following the instructions by the manufacturer. RNA concentrations were determined spectroscopically. RNAs were converted into cDNAs by reverse transcription and expression of specific targets quantified by qPCR using the ΔΔCT method and validated Taqman assays (Thermofisher). Samples were standardize to the expression levels of PPIB.

Cholesterol siRNA Conjugate Synthesis

Figure 2:
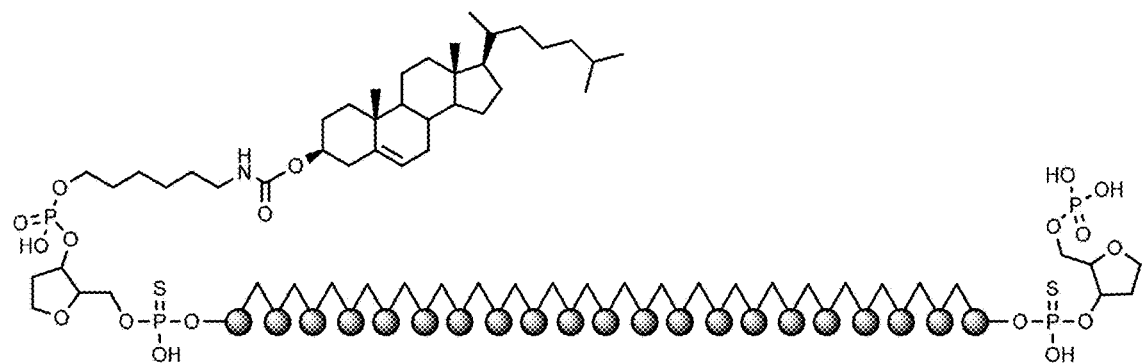
FIG. 2 illustrates a structure of cholesterol conjugate passenger strand.

All siRNA single strands were fully assembled on solid phase using standard phosphoramidite chemistry and purified over HPLC. Purified single strands were duplexed to get the double stranded siRNA. Structure of cholesterol conjugated to the passenger strand is illustrated in FIG. 2. Table 15 shows KRAS, EGFR, and CTNNB1 siRNA sequences.

TABLE 15

| siRNA | Strand | Sequence (5'-3') | MW observed | SEQ ID NO: |
|---|---|---|---|---|
| KRAS | Passenger | Chol-iBusgAfcGfaUfaCfaGfcUfaAfuUfcAfusuiB | 7813.6 | 2049 |
| KRAS | Guide | UfsGfsasAfuUfaGfcUfgUfaUfcGfuCfausu | 6874.6 | 2050 |
| EGFR | Passenger | Chol-iBasgUfuUfgCfcAfaGfgCfaCfgAfgUfusuiB | 7884.6 | 2051 |
| EGFR | Guide | asCfsusCfgUfgCfcUfuGfgCfaAfaCfuusu | 6860.6 | 2052 |
| CTNNB1 | Passenger | Chol-iBcsuGfuUfgGfaUfuGfaUfuCfgAfaAfusuiB | 7847.5 | 2053 |
| CTNNB1 | Guide | usUfsusCfgAfaUfcAfaUfcCfaAfcAfgusu | 6852.6 | 2054 |

Figure 3:
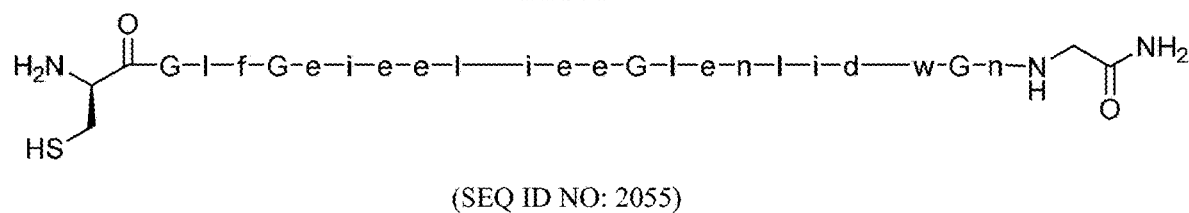
FIG. 3 shows an INF7 peptide sequence (SEQ ID NO: 2055) described herein.
Figure 4:
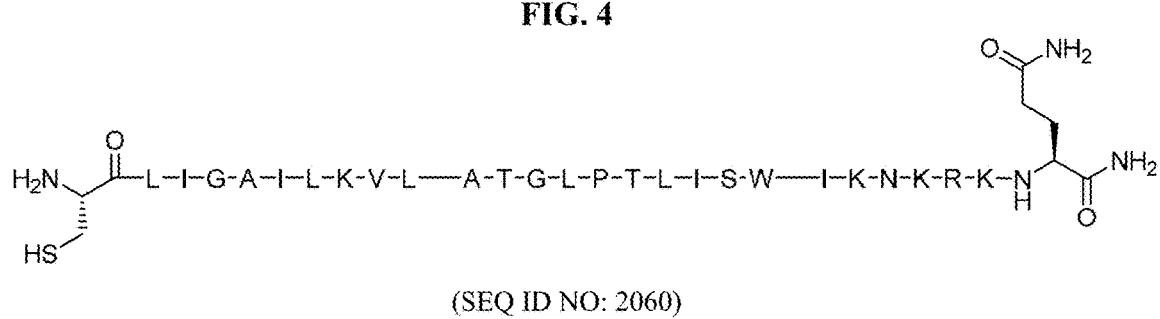
FIG. 4 shows a melittin peptide sequence (SEQ ID NO: 2060) described herein.

The siRNA chemical modifications include:
upper case (N)=2'-OH (ribo);
lower case (n)=2'-O-Me (methyl);
dN=2'-H (deoxy);
Nf=2'-F (fluoro);
s=phosphorothioate backbone modification;
iB=inverted abasic Peptide Synthesis Peptides were synthesized on solid phase using standard Fmoc chemistry. Both peptides have cysteine at the N-terminus and the cleaved peptides were purified by HPLC and confirmed by mass spectroscopy. INF7 peptide is as illustrated in FIG. 3 (SEQ ID NO: 2055). Melittin peptide is as illustrated in FIG. 4 (SEQ ID NO: 2060).

Anti-EGFR Antibody

Anti-EGFR antibody is a fully human IgG1κ monoclonal antibody directed against the human epidermal growth factor receptor (EGFR). It is produced in the Chinese Hamster Ovary cell line DJT33, which has been derived from the CHO cell line CHO-K1SV by transfection with a GS vector carrying the antibody genes derived from a human anti-EGFR antibody producing hybridoma cell line (2F8). Standard mammalian cell culture and purification technologies are employed in the manufacturing of anti-EGFR antibody.

The theoretical molecular weight (MW) of anti-EGFR antibody without glycans is 146.6 kDa. The experimental MW of the major glycosylated isoform of the antibody is 149 kDa as determined by mass spectrometry. Using SDS-PAGE under reducing conditions the MW of the light chain was found to be approximately 25 kDa and the MW of the heavy chain to be approximately 50 kDa. The heavy chains are connected to each other by two inter-chain disulfide bonds, and one light chain is attached to each heavy chain by a single inter-chain disulfide bond. The light chain has two intra-chain disulfide bonds and the heavy chain has four intra-chain disulfide bonds. The antibody is N-linked glycosylated at Asn305 of the heavy chain with glycans composed of N-acetyl-glucosamine, mannose, fucose and galactose. The predominant glycans present are fucosylated bi-antennary structures containing zero or one terminal galactose residue.

The charged isoform pattern of the IgG1κ antibody has been investigated using imaged capillary IEF, agarose IEF and analytical cation exchange HPLC. Multiple charged isoforms are found, with the main isoform having an isoelectric point of approximately 8.7.

The major mechanism of action of anti-EGFR antibody is a concentration dependent inhibition of EGF-induced EGFR phosphorylation in A431 cancer cells. Additionally, induction of antibody-dependent cell-mediated cytotoxicity (ADCC) at low antibody concentrations has been observed in pre-clinical cellular in vitro studies.

Example 3: Synthesis, Purification and Analysis of Antibody-PEG-EGFR and Antibody-EGFR Conjugates—Conjugation Scheme 1

Step 1: Antibody Conjugation with Maleimide-PEG-NHS Followed by SH-EGFR

Figure 88:
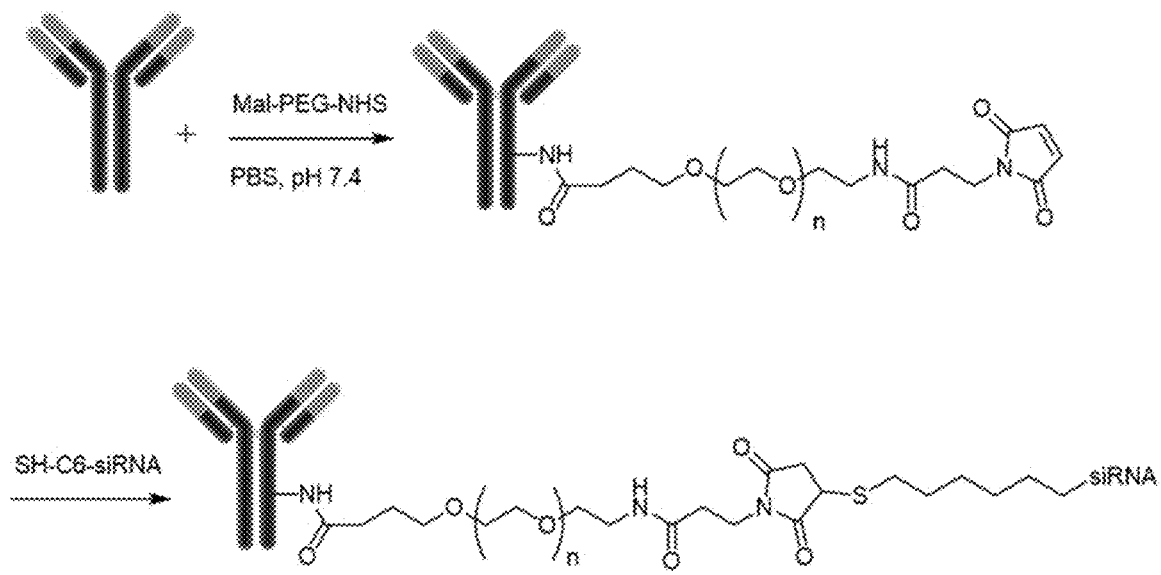
FIG. 88 illustrates Conjugation scheme 1.

Anti-EGFR antibody (EGFR-Ab) was exchanged with 1× Phosphate buffer (pH 7.4) and made up to 5 mg/ml concentration. To this solution, 2 equivalents of SMCC linker or maleimide-PEGxkDa-NHS (x=1, 5, 10, 20) was added and rotated for 4 hours at room temperature. Unreacted maleimide-PEG was removed by spin filtration using 50 kDa MWCO Amicon spin filters and PBS pH 7.4. The antibody-PEG-Mal conjugate was collected and transferred into a reaction vessel. SH-C6-EGFR (2 equivalents) was added at RT to the antibody-PEG-maleimide in PBS and rotated overnight, see FIG. 88. The reaction mixture was analyzed by analytical SAX column chromatography and conjugate along with unreacted antibody and siRNA was seen.

Step 2: Purification

The crude reaction mixture was purified by AKTA explorer FPLC using anion exchange chromatography method-1. Fractions containing the antibody-PEG-EGFR conjugate were pooled, concentrated and buffer exchanged with PBS, pH 7.4. Antibody siRNA conjugates with SMCC linker, PEG1kDa, PEG5kDa and PEG10kDa were separated based on the siRNA loading. Conjugates with PEG20kDa gave poor separation.

Step-3: Analysis of the Purified Conjugate

The isolated conjugate was characterized by either mass spec or SDS-PAGE. The purity of the conjugate was assessed by analytical HPLC using either anion exchange chromatography method-2 or anion exchange chromatography method-3. Examples of all the conjugates made using these methods are described in Table 16.

TABLE 16

List of AXCYB conjugates

| Conjugate | HPLC retention time (minutes) with Anion exchange chromatography method-2 | | |
|---|---|---|---|
| | DAR = 1 | DAR = 2 | DAR = >2 |
| EGFR-Ab-EGFR | 9.0 | 9.9 | 10.4 |
| EGFR-Ab-PEG1 kDa-EGFR | 9.2 | 10.0 | 10.6 |
| EGFR-Ab-PEG5 kDa-EGFR | 8.7 | 9.3 | ND |
| EGFR-Ab-PEG10 kDa-EGFR | 8.6 | 8.8 to 10; mix of DAR 2-3 | |
| EGFR-Ab-PEG20 kDa-EGFR | 8.6; Mixture of DAR of 1-3 | | |
| Holo-anti-B cell Ab-PEG20 kDa-EGFR | 9.2 | | 9.5 |

Anion exchange chromatography method-1

1. Column: Tosoh Bioscience, TSKGel SuperQ-SPW, 21.5 mm ID×15 cm, 13 um
2. Solvent A: 20 mM TRIS buffer, pH 8.0; Solvent B: 20 mM TRIS, 1.5 M NaCl, pH 8.0; Flow Rate: 6.0 ml/min
3. Gradient:

| a. | % A | % B | Column Volume |
|---|---|---|---|
| b. | 100 | 0 | 1.00 |
| c. | 60 | 40 | 18.00 |
| d. | 40 | 60 | 2.00 |
| e. | 40 | 60 | 5.00 |
| f. | 0 | 100 | 2.00 |
| g. | 100 | 0 | 2.00 |

Anion Exchange Chromatography Method-2

1. Column: Thermo Scientific, ProPac™ SAX-10, Bio LC™, 4×250 mm
2. Solvent A: 80% 10 mM TRIS pH 8, 20% ethanol; Solvent B: 80% 10 mM TRIS pH 8, 20% ethanol, 1.5 M NaCl; Flow Rate: 1.0 ml/min 3. Gradient:

| a. | Time | % A | % B |
|---|---|---|---|
| b. | 0.0 | 90 | 10 |
| c. | 3.00 | 90 | 10 |
| d. | 11.00 | 40 | 60 |
| e. | 13.00 | 40 | 60 |
| f. | 15.00 | 90 | 10 |
| g. | 20.00 | 90 | 10 |

Anion Exchange Chromatography Method-3
1. Column: Thermo Scientific, ProPac™ SAX-10, Bio LC™, 4×250 mm
2. Solvent A: 80% 10 mM TRIS pH 8, 20% ethanol; Solvent B: 80% 10 mM TRIS pH 8, 20% ethanol, 1.5 MNaCl
3. Flow Rate: 0.75 ml/min
4. Gradient:

| a. | Time | % A | % B |
|---|---|---|---|
| b. | 0.0 | 90 | 10 |
| c. | 3.00 | 90 | 10 |
| d. | 11.00 | 40 | 60 |
| e. | 23.00 | 40 | 60 |
| f. | 25.00 | 90 | 10 |
| g. | 30.00 | 90 | 10 |

Figure 5:
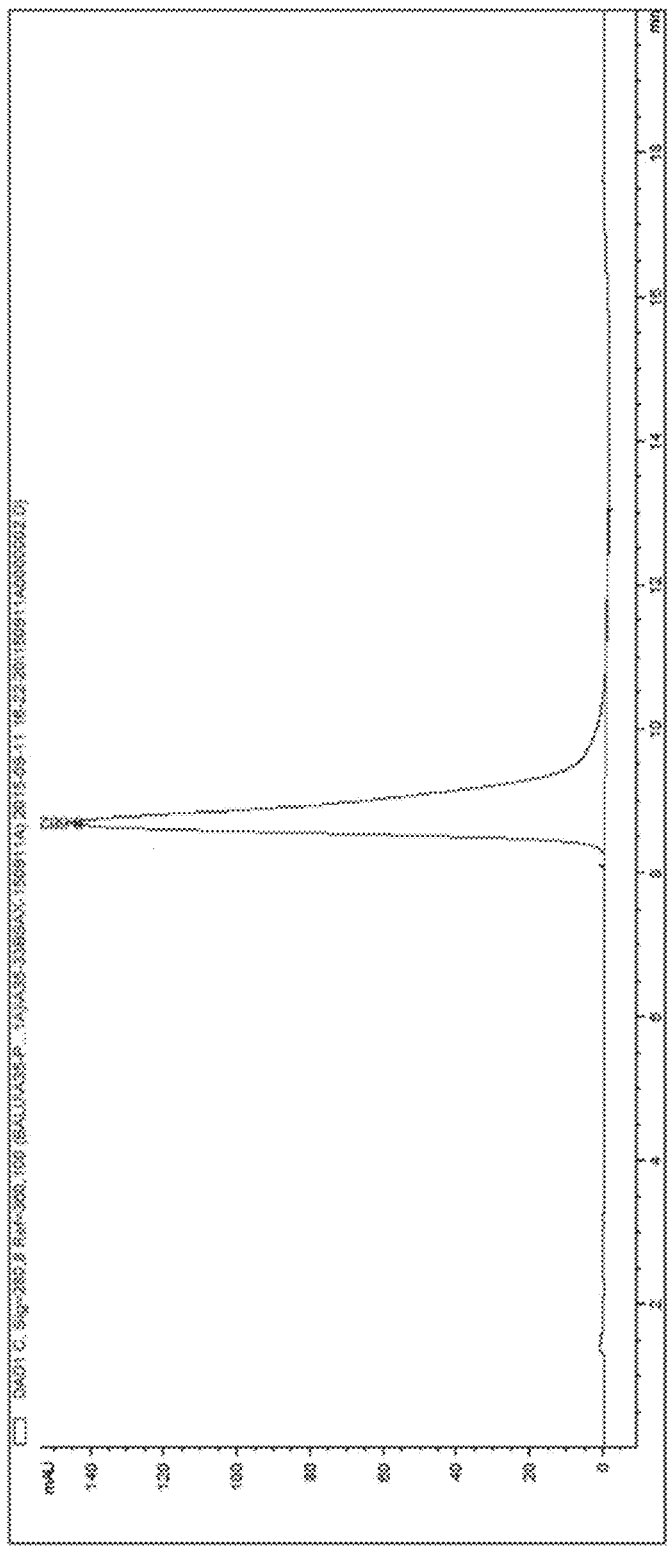
FIG. 5 illustrates an analytical HPLC of EGFR antibody-PEG20kDa-EGFR.
Figure 6:
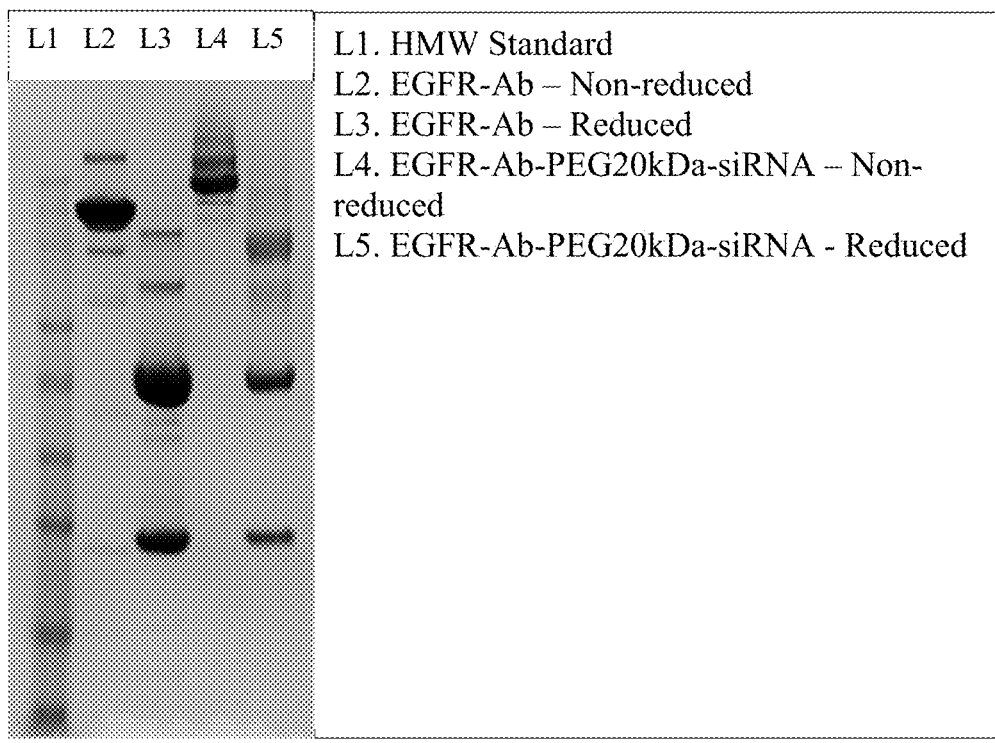
FIG. 6 illustrates a SDS-PAGE analysis of EGFR antibody-PEG20kDa-EGFR conjugate.
Figure 7:
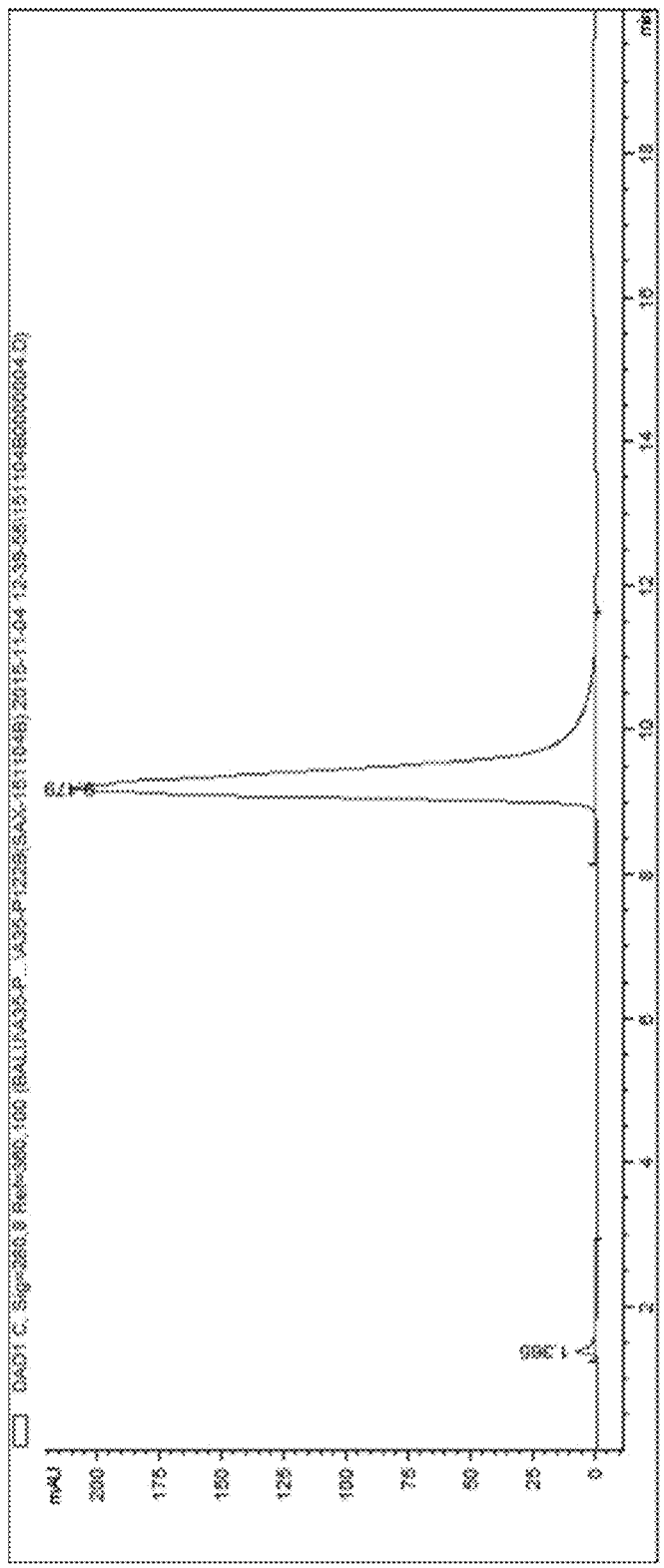
FIG. 7 illustrates an analytical chromatogram of EGFR antibody-PEG10kDa-EGFR siRNA.
Figure 8:
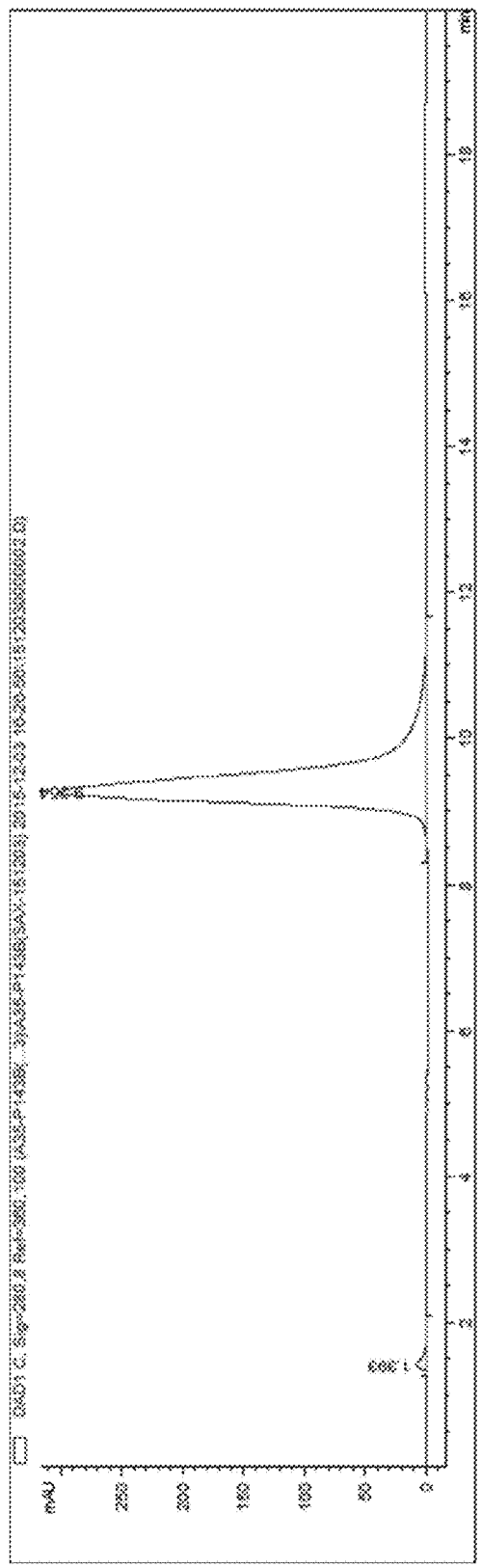
FIG. 8 shows an analytical chromatogram of EGFR antibody-PEG5kDa-EGFR siRNA.
Figure 9:
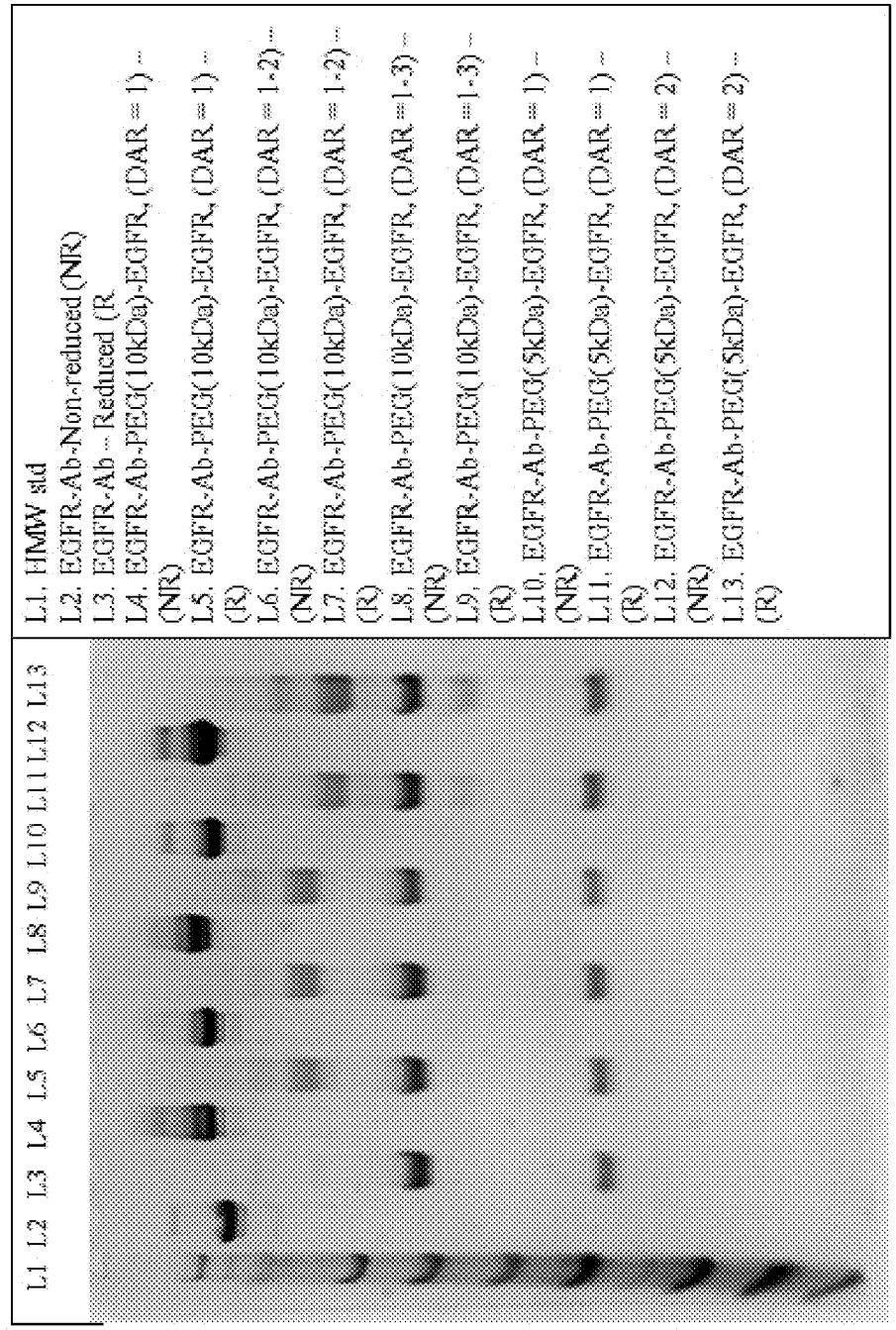
FIG. 9 shows a SDS PAGE analysis of EGFR antibody-PEG10kDa-EGFR siRNA and EGFR antibody-PEG5kDa-EGFRsiRNA conjugates.
Figure 10:
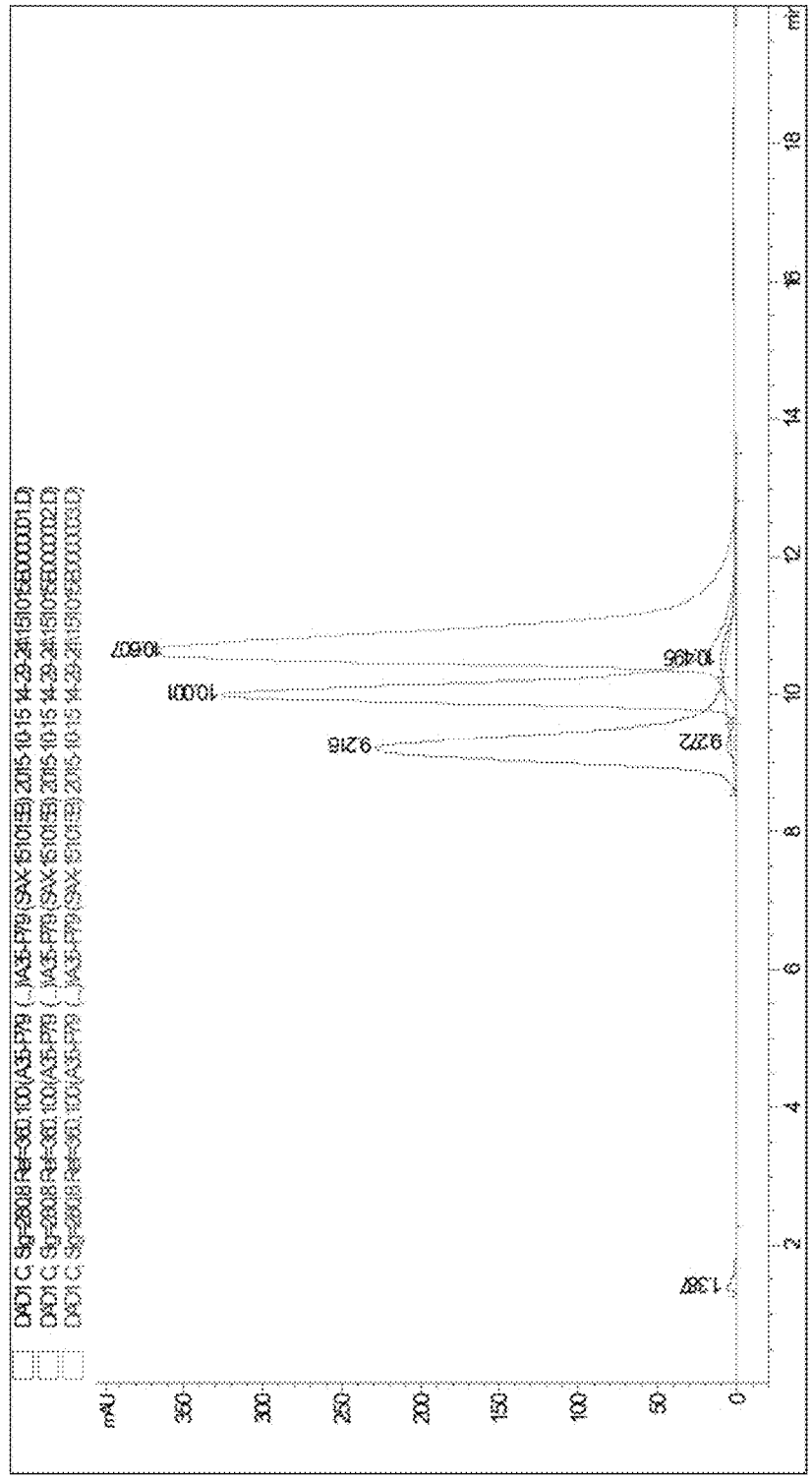
FIG. 10 illustrates the overlay of EGFR antibody-PEG1kDa-EGFR siRNA conjugates with siRNA loading of 1, 2 and 3.

The analytical data for EGFR antibody-PEG20kDa-EGFR are illustrated in FIG. 5 and FIG. 6. FIG. 5 shows the analytical HPLC of EGFR antibody-PEG20kDa-EGFR. FIG. 6 shows a SDS-PAGE analysis of EGFR antibody-PEG20kDa-EGFR conjugate. The analytical chromatogram of EGFR antibody-PEG10kDa-EGFR is illustrated in FIG. 7. The analytical data for EGFR antibody-PEG5kDa-EGFR are illustrated in FIG. 8 and FIG. 9. FIG. 8 shows the analytical chromatogram of EGFR antibody-PEG5kDa-EGFR. FIG. 9 shows SDS PAGE analysis of EGFR antibody-PEG10kDa-EGFR and EGFR antibody-PEG5kDa-EGFR conjugates. The analytical data for EGFR antibody-PEG1kDa-EGFR conjugates with different siRNA loading is illustrated in FIG. 10.

Example 4: Synthesis, Purification and Analysis of Antibody-siRNA-PEG Conjugates—Conjugation Scheme-2

Step 1: Antibody Conjugation with SMCC Linker Followed by SH-KRAS-PEG5kDa

Figure 89:
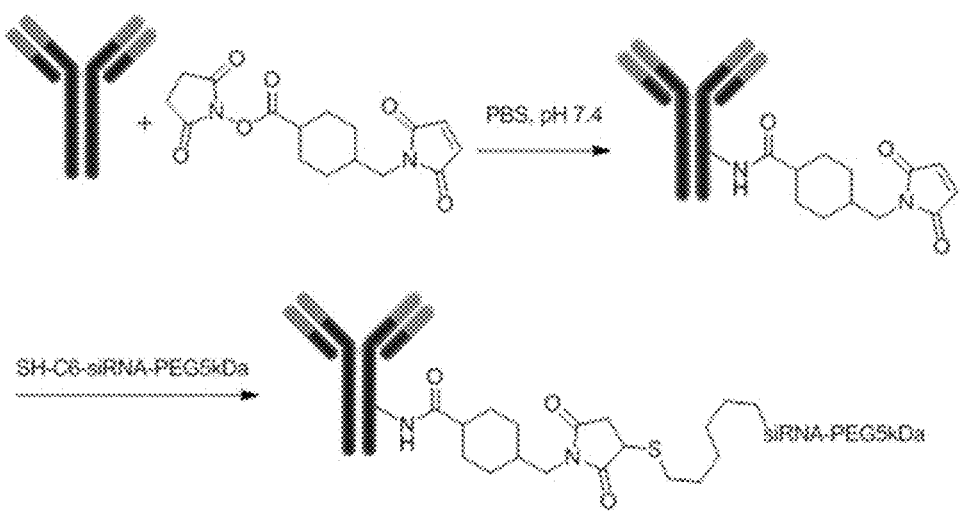
FIG. 89 illustrates Conjugation scheme 2.

Anti-EGFR antibody was exchanged with 1× Phosphate buffer (pH 7.4) and made up to 5 mg/ml concentration. To this solution, 2 equivalents of SMCC linker (succinimidyl 4-(N-maleimidomethyl)cyclohexane-1-carboxylate) was added and rotated for 4 hours at room temperature, see FIG. 89. Unreacted SMCC linker was removed by spin filtration using 50 kDa MWCO Amicon spin filters and PBS buffer pH 7.4. The retentate was collected and 2 equivalents of SH-C6-KRAS-PEG5kDa was added at RT and rotated overnight. The reaction mixture was analyzed by analytical SAX column chromatography and the conjugate along with unreacted antibody and siRNA was observed.

Step 2: Purification

The crude reaction mixture was purified by AKTA explorer FPLC using anion exchange chromatography method-1. Fractions containing the antibody-KRAS-PEG conjugate were pooled, concentrated and buffer exchanged with PBS, pH 7.4.

Step-3: Analysis of the Purified Conjugate

The isolated conjugate was characterized by either mass spec or SDS-PAGE. The purity of the conjugate was assessed by analytical HPLC using anion exchange chromatography method-3 (described in example 1). Examples of the conjugates made using the methods described in Examples 4 and 5 are illustrated in Table 17.

TABLE 17

List of A-X-B-Y-C conjugates

| Conjugate | HPLC retention time (minutes) with Anion exchange chromatography method-3 | | |
|---|---|---|---|
| | DAR = 1 | DAR = 2 | DAR = >2 |
| EGFR-Ab-KRAS-PEG5kDa | 9.2 | | |
| EGFR-Ab-S-S-KRAS-PEG5kDa | 9.0 | | |
| Holo-anti-B cell Ab-KRAS-PEG5kDa | 9.2 | 9.7 | 10.1 |
| Panitumumab-KRAS-PEG5kDa | 9.2 | 9.7 | 10.2 |

Figure 11:
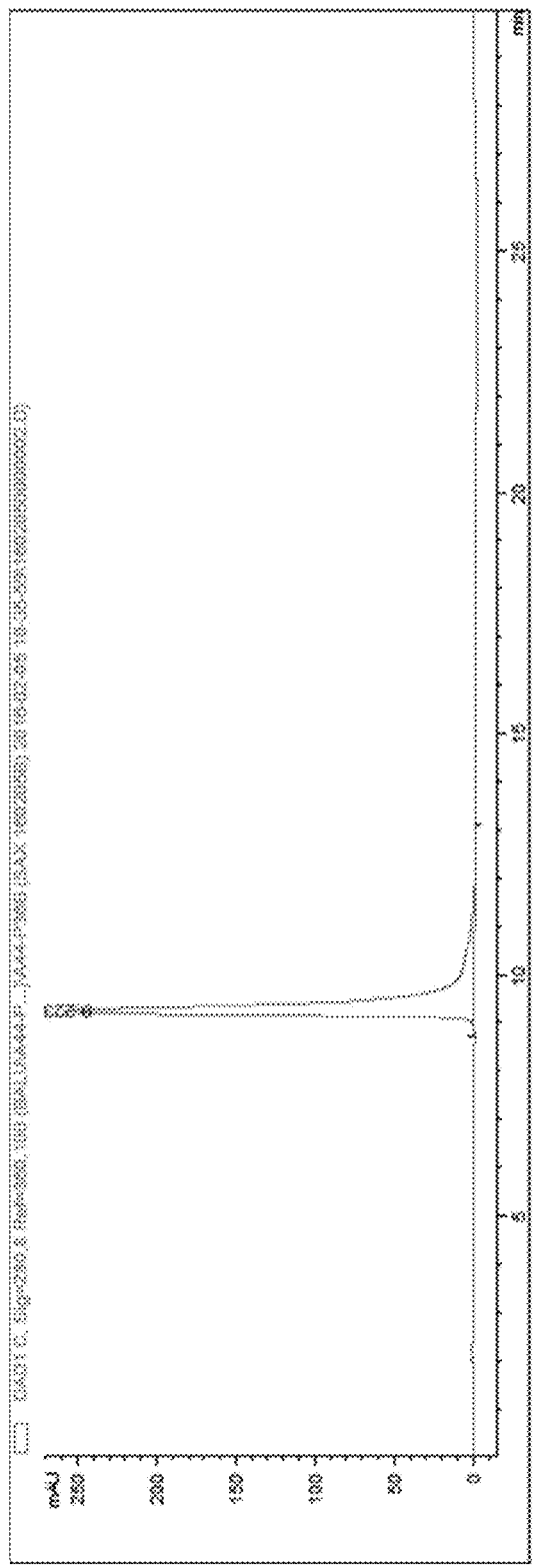
FIG. 11 shows a HPLC chromatogram of EGFR antibody-KRAS-PEG5kDa.
Figure 12:
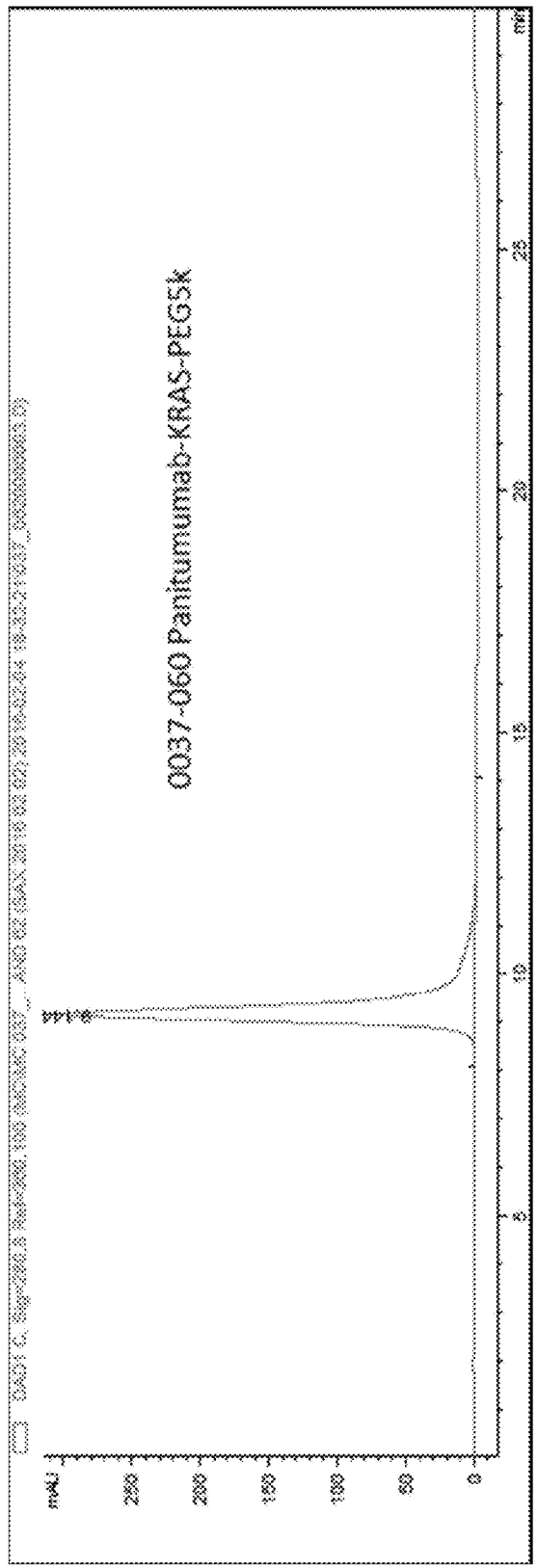
FIG. 12 shows a HPLC chromatogram of Panitumumab-KRAS-PEG5kDa.

The HPLC chromatogram of EGFR Antibody-KRAS-PEG5kDa is illustrated in FIG. 11. The HPLC chromatogram of Panitumumab-KRAS-PEG5kDa is as shown in FIG. 12.

Example 5: Synthesis, Purification and Analysis of Antibody-S-S-siRNA-PEG Conjugates—Conjugation Scheme-3

Step 1: Antibody Conjugation with SPD Linker Followed by SH-siRNA-PEG5kDa

Figure 90:
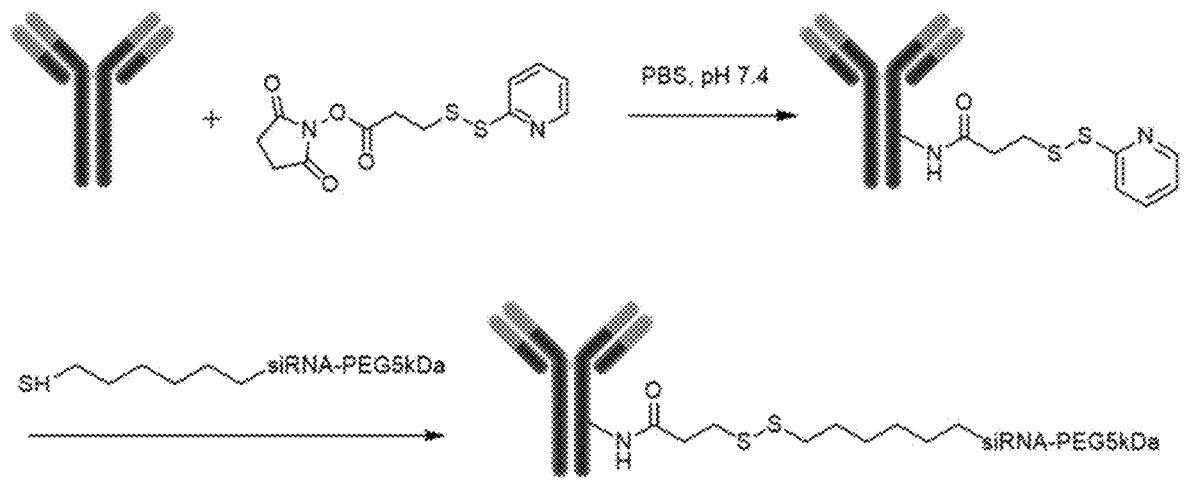
FIG. 90 illustrates Conjugation scheme 3.
Figure 91:
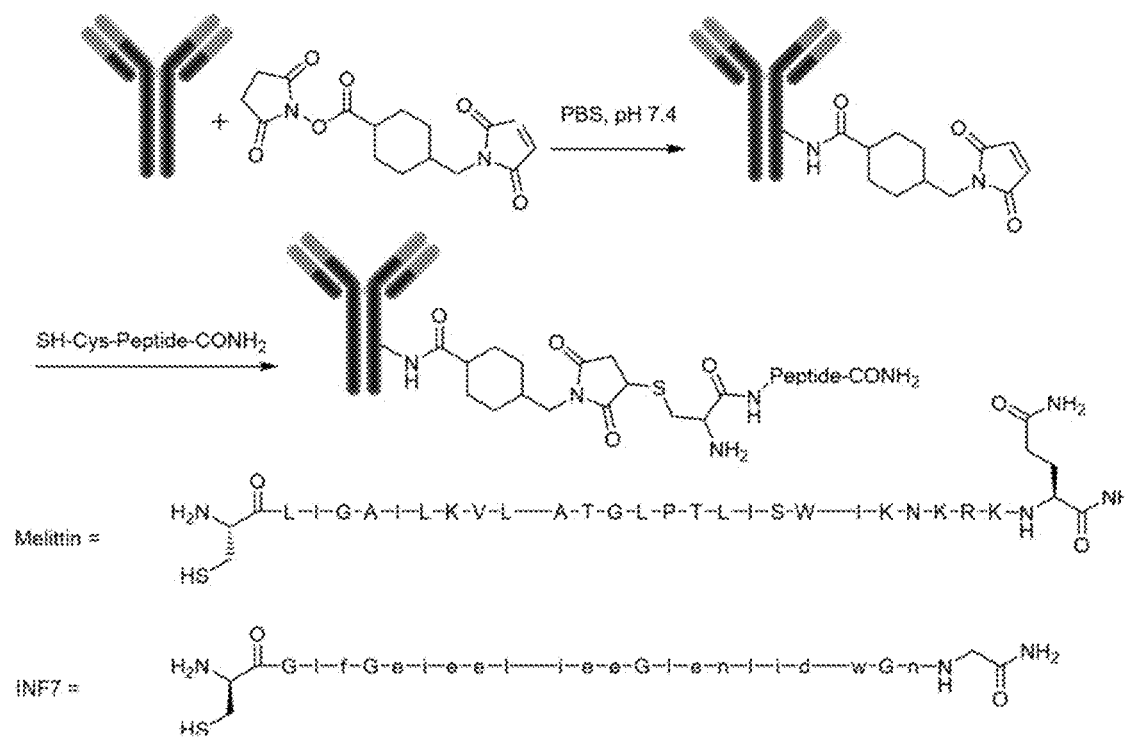
FIG. 91 illustrates Conjugation scheme 4.

Anti-EGFR antibody was exchanged with 1× Phosphate buffer (pH 7.4) and made up to 5 mg/ml concentration. To this solution, 2 equivalents of SPDP linker (succinimidyl 3-(2-pyridyldithio)propionate) was added and rotated for 4 hours at room temperature. Unreacted SPDP linker was removed by spin filtration using 50 kDa MWCO Amicon spin filters and pH 7.4 PBS buffer. The retentate was collected and 2 equivalents of SH-C6-siRNA-PEG5kDa was added at room temperature and rotated overnight. See FIG. 90. The reaction mixture was analyzed by analytical SAX column chromatography and conjugate along with unreacted antibody and siRNA was seen.

Step 2: Purification

The crude reaction mixture was purified by AKTA explorer FPLC using anion exchange chromatography method-1. Fractions containing the antibody-PEG-siRNA conjugate were pooled, concentrated and buffer exchanged with PBS, pH 7.4.

Step-3: Analysis of the Purified Conjugate

Figure 13:
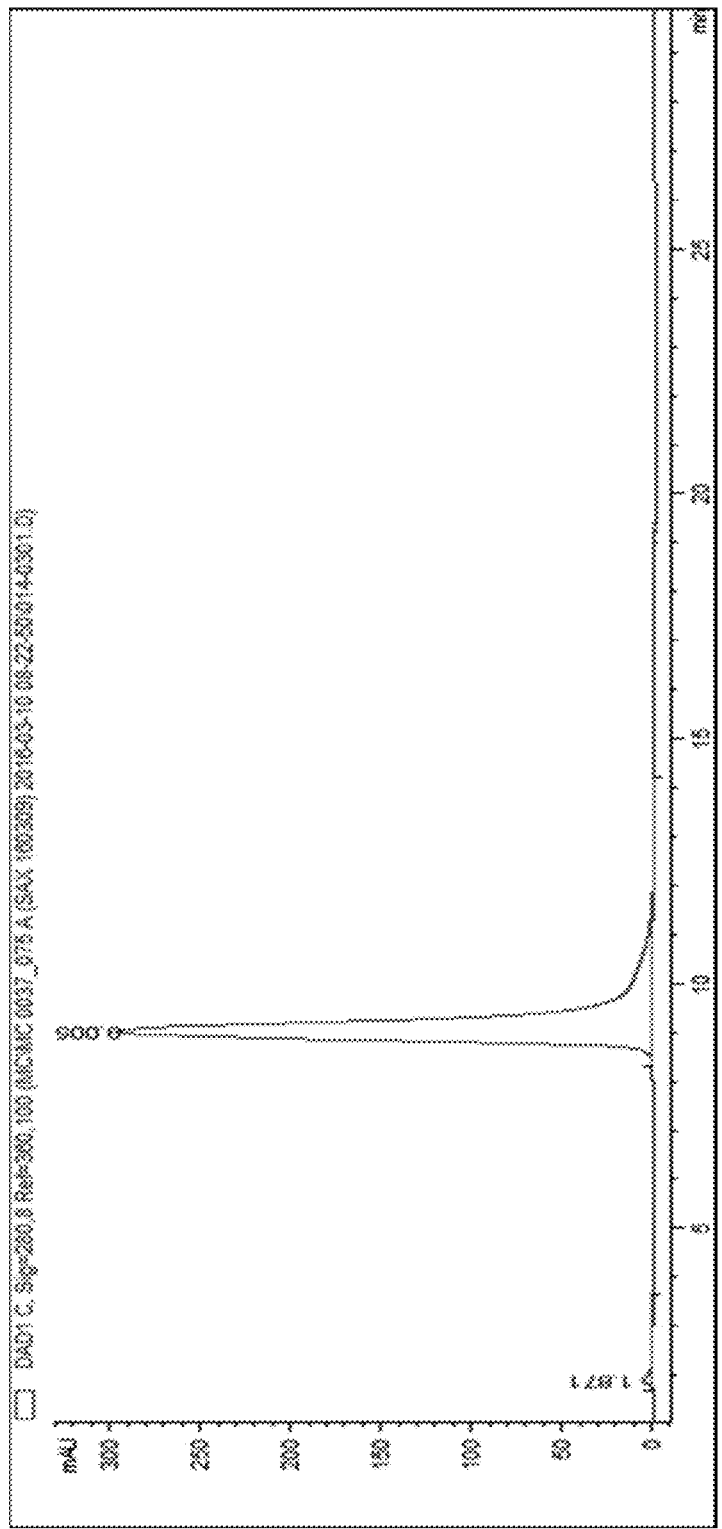
FIG. 13 shows a HPLC chromatogram of EGFR antibody-S-S-siRNA-PEG5kDa (DAR=1).

The isolated conjugate was characterized by either mass spec or SDS-PAGE. The purity of the conjugate was assessed by analytical HPLC using anion exchange chromatography method-2. The HPLC chromatogram of EGFR Antibody-S-S-siRNA-PEG5kDa (DAR=1) is as shown in FIG. 13.

Example 6: Synthesis, Purification and Analysis of Antibody-SMCC-Endosomal Escape Peptide Conjugates—Conjugation Scheme-4

Step 1: Antibody Conjugation with SMCC Linker or Maleimide-PEG-NHS Followed by SH-Cys-Peptide-CONH$_2$ Anti-EGFR antibody was exchanged with 1× Phosphate buffer (pH 7.4) and made up to 10 mg/ml concentration. To this solution, 3 equivalents of SMCC linker (succinimidyl 4-(N-maleimidomethyl)cyclohexane-1-carboxylate) or maleimide-PEG1kDa-NHS was added and rotated for 1.5 hours at room temperature. Unreacted SMCC linker or PEG linker was removed by spin filtration using 50 kDa MWCO Amicon spin filters and PBS buffer pH 7.4 (25 mM MES pH=6.1 for Melittin conjugates). The retentate was collected and 3 equivalents of SH-Cys-Peptide-CONH$_2$ was added at RT and rotated overnight. See FIG. 9I. The reaction mixture was then purified by either HIC chromatography or cation exchange chromatography to isolate the anti-EGFR antibody-Peptide or anti-EGFR antibody-PEG1k-Peptide.

Step 2: Purification

The crude reaction mixture was purified by AKTA explorer FPLC using either hydrophobic interaction chromatography (HIC) method-1 or cation exchange chromatography method-1. Fractions containing the antibody-peptide conjugates were pooled, concentrated and buffer exchanged with PBS, pH 7.4 (10 mM Acetate pH=6.0 for Melittin conjugates).

Step-3: Analysis of the Purified Conjugate

The isolated conjugate was characterized by either mass spec or SDS-PAGE. Purity and peptide loading was assessed by analytical HPLC using either HIC method-2 or cation exchange chromatography method-2. Examples of all the conjugates made using the method of Example 6 are described in Tables 18 and 19.

TABLE 18

List of AXYD conjugates

| Conjugate | HPLC retention time (minutes) with HIC method-2 | | |
|---|---|---|---|
| | DAR = 1 | DAR = 2 | DAR = >2 |
| EGFR-Ab-INF7 | 7.7 | 9.3 | 11.2 |
| EGFR-Ab-PEG24-INF7 | 8.4 | 12.2 | 15.2 |

TABLE 19

List of AXYD conjugates

| Conjugate | HPLC retention time (minutes) with cation exchange chromatography method-2 | | |
|---|---|---|---|
| | DAR = 1 | DAR = >1 | DAR = >2 |
| EGFR-Ab-Melittin | 40.9 | 54.8 | |
| EGFR-Ab-PEG1kDa-melittin | 48. | 53.4 | 55.8 |

Cation Exchange Chromatography Method-1
1. Column: GE Healthcare HiPrep SP HP 16/10
2. Solvent A: 50 mM MES pH=6.0; Solvent B: 50 mM MES+0.5M NaCl pH=6.0; Flow Rate: 2.0 ml/min
3. Gradient:

| a. | % A | % B | Column Volume |
|---|---|---|---|
| b. | 100 | 0 | 0.1 |
| c. | 100 | 0 | Flush loop 12 ml |
| d. | 100 | 0 | 2.5 |
| e. | 0 | 100 | 15 |
| f. | 0 | 100 | 5 |
| g. | 100 | 0 | 0.5 |
| h. | 100 | 0 | 5 |

Cation Exchange Chromatography Method-2
1. Column: Thermo Scientific, MAbPac™ SCX-10, Bio LC™, 4×250 mm (product #074625)
2. Solvent A: 20 mM MES pH=5.5; Solvent B: 20 mM MES+0.3 M NaCl pH=5.5; Flow Rate: 0.5 ml/min
3. Gradient:

| a. | Time | % A | % B |
|---|---|---|---|
| b. | 0.0 | 100 | 0 |
| c. | 5 | 100 | 0 |
| d. | 50 | 0 | 100 |
| e. | 80 | 0 | 100 |
| f | 85 | 100 | 0 |
| g. | 90 | 100 | 0 |

Hydrophobic Interaction Chromatography Method-1 (HIC Method-1)
1. Column: GE Healthcare Butyl Sepharose High Performance (17-5432-02) 200 ml
2. Solvent A: 50 mM Sodium Phosphate+0.8M ammonium sulfate (pH=7.0); Solvent B: 80% 50 mM Sodium Phosphate (pH=7.0), 20% IPA; Flow Rate: 3.0 ml/min
3. Gradient:

| a. | % A | % B | Column Volume |
|---|---|---|---|
| b. | 100 | 0 | 0.1 |
| c. | 0 | 100 | 3 |
| d. | 0 | 100 | 1.35 |
| e. | 100 | 0 | 0.1 |
| f | 100 | 0 | 0.5 |

Hydrophobic Interaction Chromatography Method-2 (HIC Method-21
1. Column: Tosoh Bioscience TSKgel Butyl-NPR 4.6 mm ID×10 cm 2.5
2. Solvent A: 100 mM Sodium phosphate+1.8 M ammonium sulfate (pH=7.0); Solvent B: 80% 100 mM sodium phosphate (pH=7.0), 20% IPA; Flow Rate: 0.5 ml/min
3. Gradient:

| a. | Time | % A | % B |
|---|---|---|---|
| b. | 0 | 100 | 0 |
| c. | 3 | 50 | 50 |
| d. | 21 | 0 | 100 |
| e. | 23 | 0 | 100 |
| f | 25 | 100 | 0 |

Figure 14:
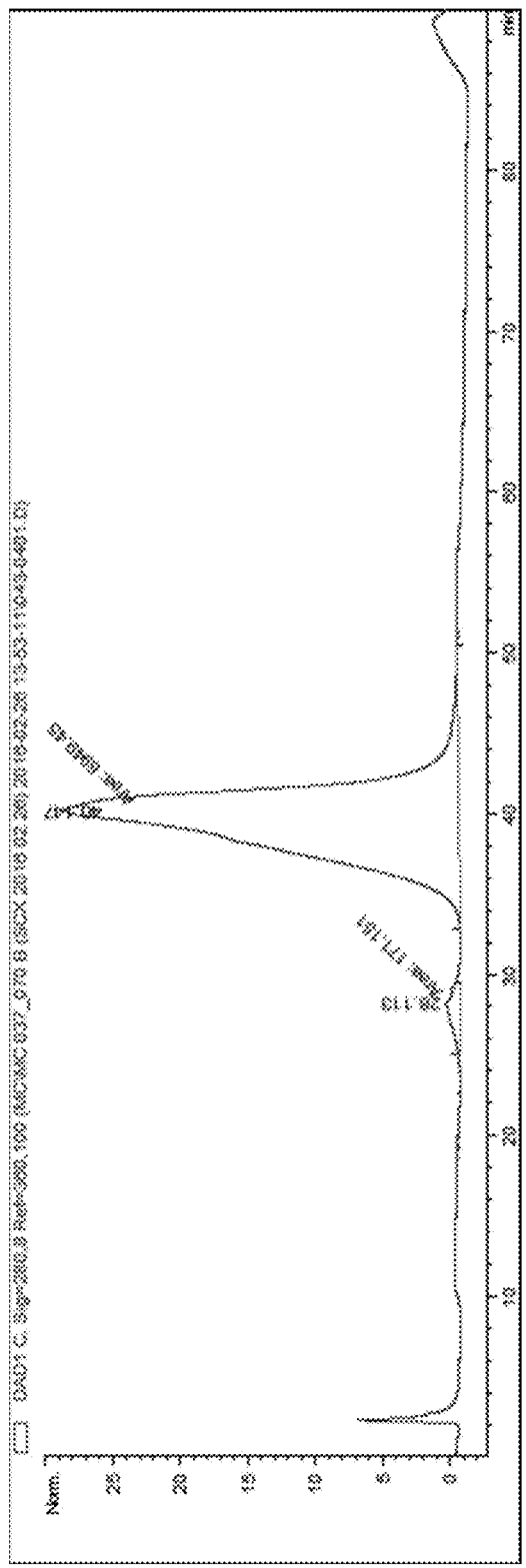
FIG. 14 shows a HPLC chromatogram of EGFR antibody-PEG24-Melittin (loading=~1).
Figure 15:
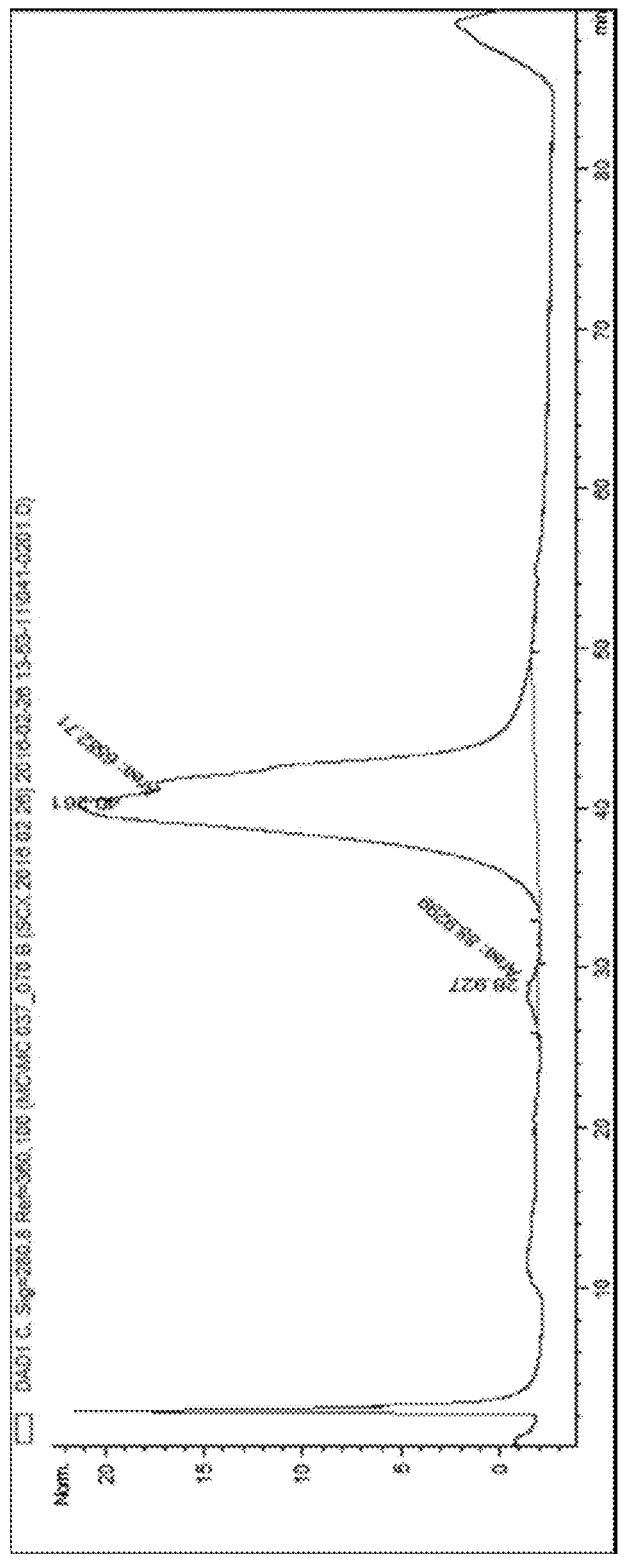
FIG. 15 illustrates a HPLC chromatogram of EGFR antibody-Melittin (n=~1).
Figure 16:
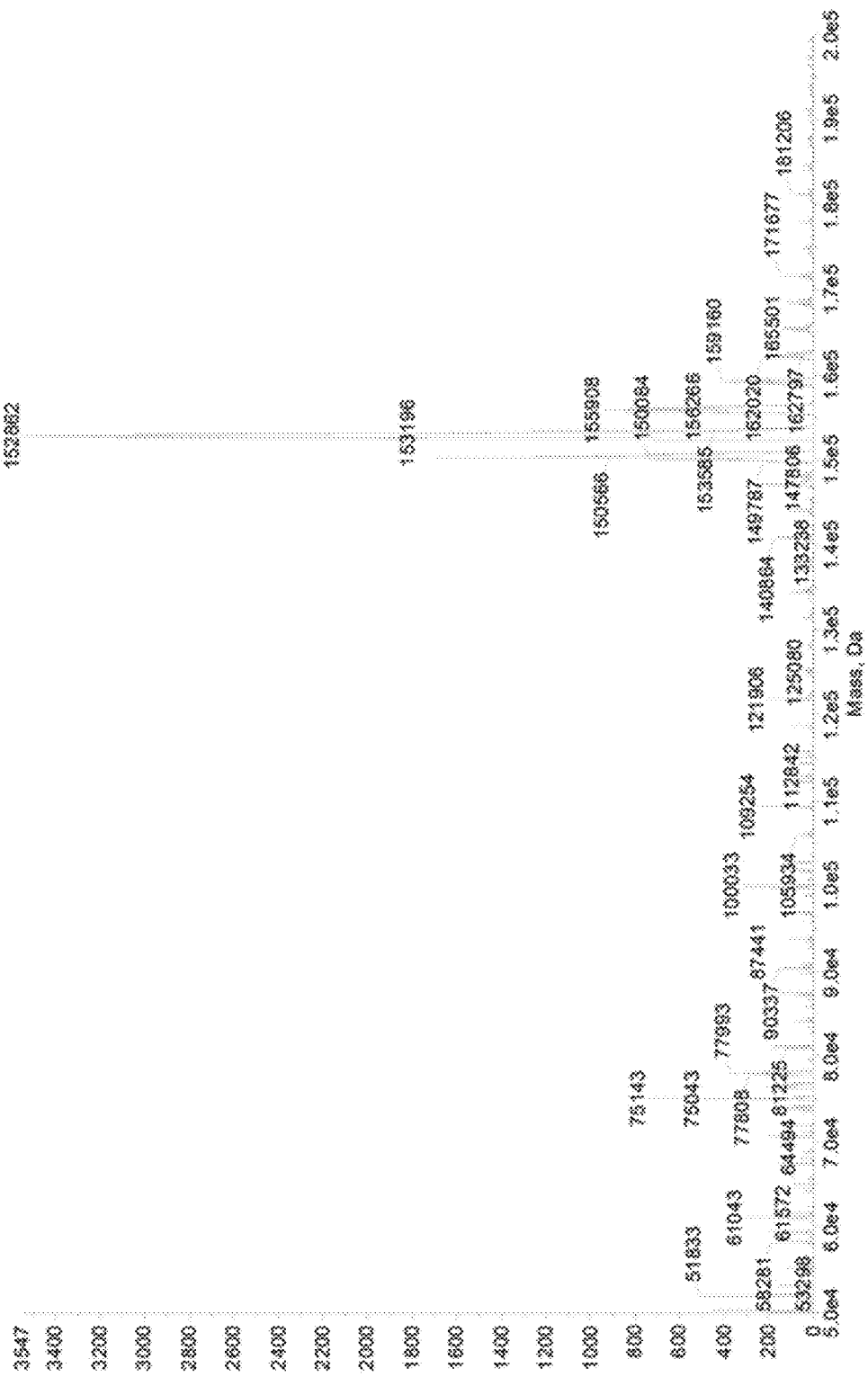
FIG. 16 illustrates a mass spectrum of EGFR antibody-Melittin (n=1).
Figure 17:
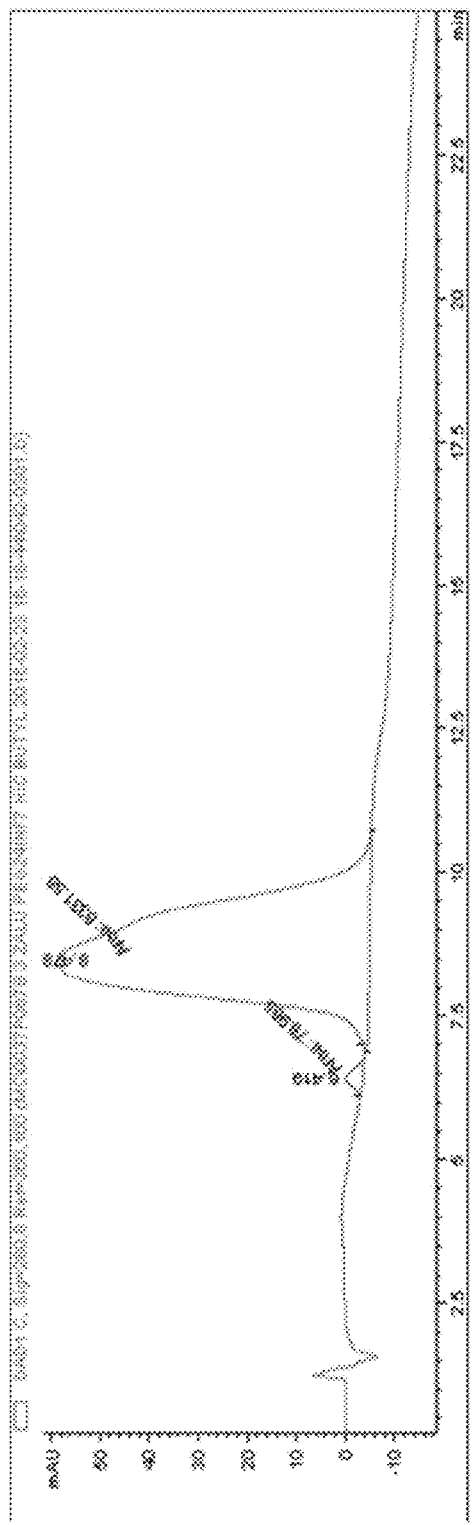
FIG. 17 shows a HIC chromatogram of EGFR antibody-PEG1kDa-INF7 (Peptide loading=~1).
Figure 18:
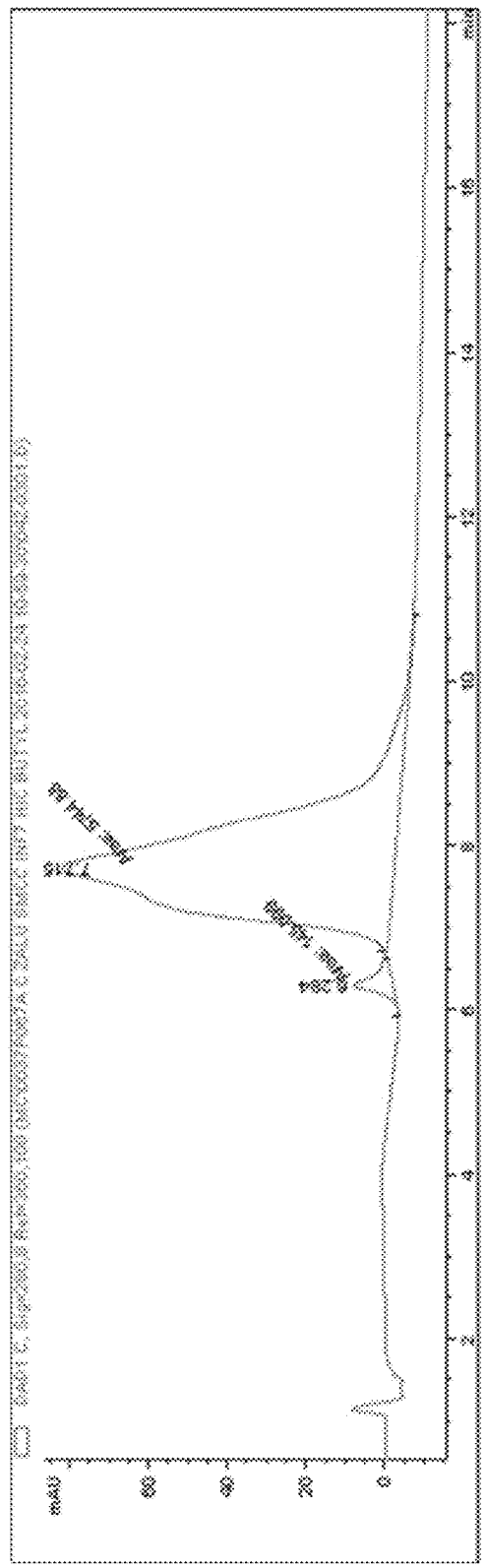
FIG. 18 shows a HPLC chromatogram of EGFR antibody-INF7 (Peptide Loading=~1).

FIG. 14 illustrates the HPLC chromatogram of EGFR antibody-PEG24-Melittin (loading=~1). FIG. 15 illustrates the HPLC chromatogram of EGFR antibody-Melittin (n=~1). FIG. 16 shows the mass spectrum of EGFR antibody-Melittin (n=1). FIG. 17 shows the HIC chromatogram of EGFR antibody-PEG1kDa-INF7 (Peptide loading=~1). FIG. 18 shows the HPLC chromatogram of EGFR antibody-INF7 (Peptide Loading=~1).

Example 7: Synthesis, Purification and Analysis of EEP-Antibody-siRNA-PEG Conjugates—Conjugation Scheme-5

Figure 92:
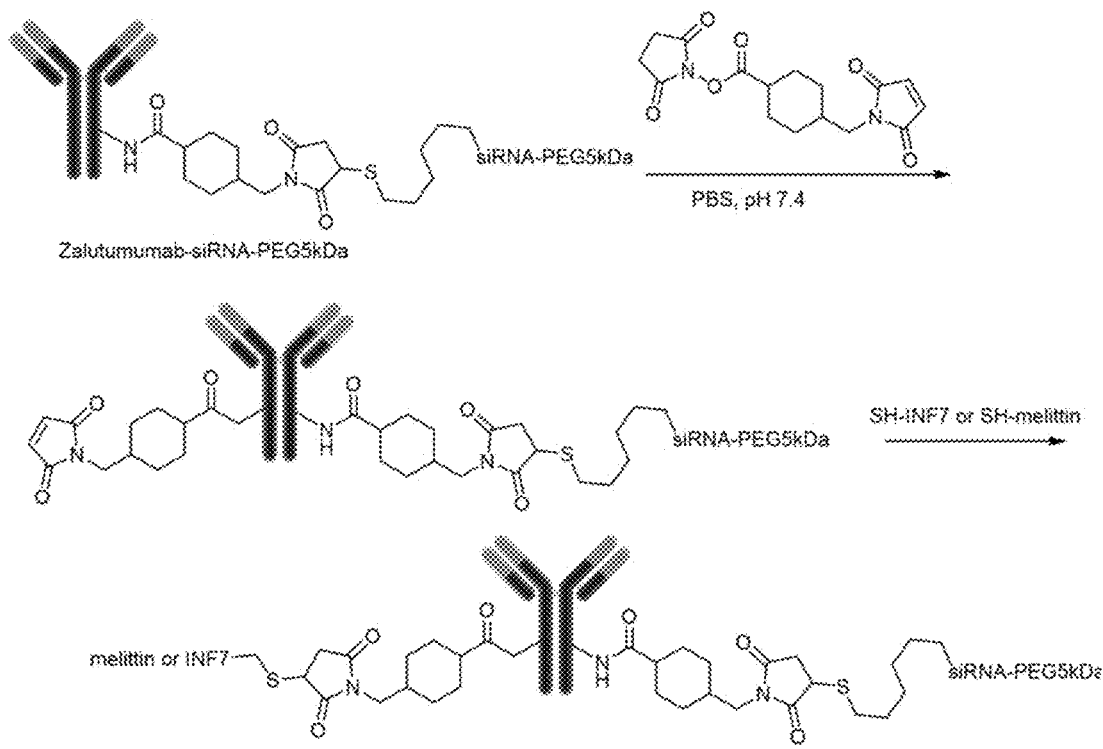
FIG. 92 illustrates Conjugation scheme 5.

Step 1: Conjugation of PEG24 Linker Followed by SH-Cys-Peptide-CONH$_2$ to EGFR-Ab-siRNA-PEG EGFR-Ab-siRNA-PEG5kDa EGFR-Ab-siRNA-PEG conjugate with a siRNA loading of 1 was conjugated with 4 equivalents of PEG1k linker (succinimidyl 4-(N-maleimidomethyl)cyclohexane-1-carboxylate) in PBS, pH 7.4 buffer and rotated for 1.5 hours at room temperature. See FIG. 92. Unreacted PEG1k linker was removed by spin filtration using 50 kDa MWCO Amicon spin filters and PBS buffer pH 7.4. The retentate was collected and 4 equivalents of SH-Cys-Peptide-CON H$_2$ was added at RT and rotated overnight.

Step 2: Purification

The reaction mixture was then purified by repeated spin filtration using PBS buffer pH7.4 and 50 kDa Amicon spin filters until the unreacted peptide was removed as monitored by HPLC. The product contains a mixture of conjugates with 0, 1, 2, 3 or more peptides conjugated to the antibody backbone.

Step-3: Analysis of the Purified Conjugate

The isolated conjugate was characterized by either mass spec or SDS-PAGE. The purity and the peptide loading of the conjugate was assessed by analytical HPLC using either HIC method-2 or cation exchange chromatography method-2. Examples of the conjugates made using the method described in Example 7 are shown in Table 20.

TABLE 20

List of (A-X-B-Y-Cn)-L-D conjugates

| Conjugate | HPLC retention time (minutes) with cation exchange chromatography method-2 | | | |
|---|---|---|---|---|
| | DAR = 0 | DAR = 1 | DAR = 2 | DAR = 3 |
| (EGFR-Ab-siRNA-PEG5kDa)-PEG1k-INF7 | 24 | 38 | 27 | 9 |

TABLE 20-continued

List of (A-X-B-Y-Cn)-L-D conjugates

| Conjugate | HPLC retention time (minutes) with cation exchange chromatography method-2 | | | |
|---|---|---|---|---|
| | DAR = 0 | DAR = 1 | DAR = 2 | DAR = 3 |
| (EGFR-Ab-siRNA-PEG5kDa)-PEG1k-melittin | 24 | | 11.79 (broad peak) | |

Figure 19:
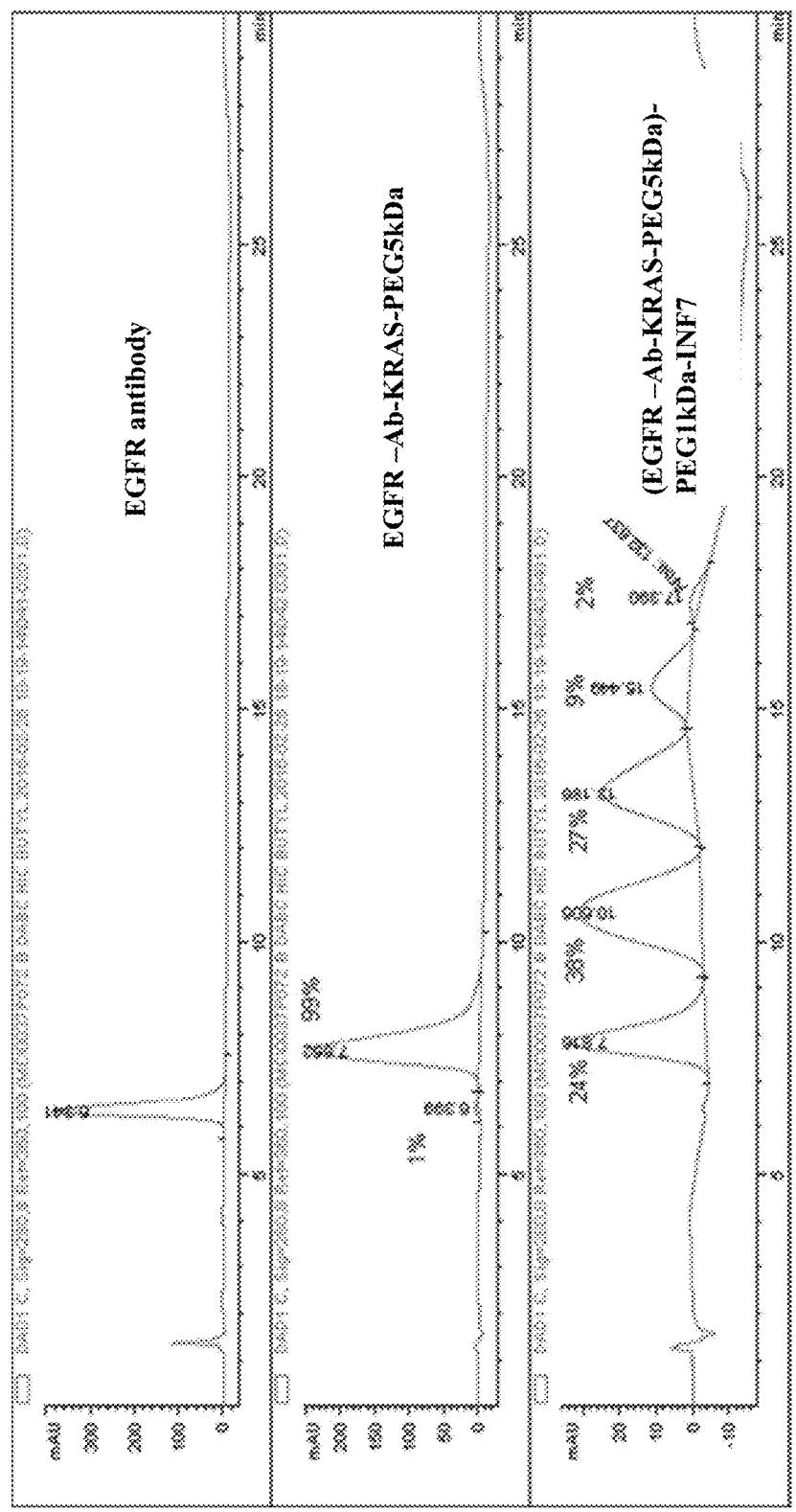
FIG. 19 shows INF7-PEG1kDa-(EGFR antibody-KRAS-PEG5kDa).
Figure 20:
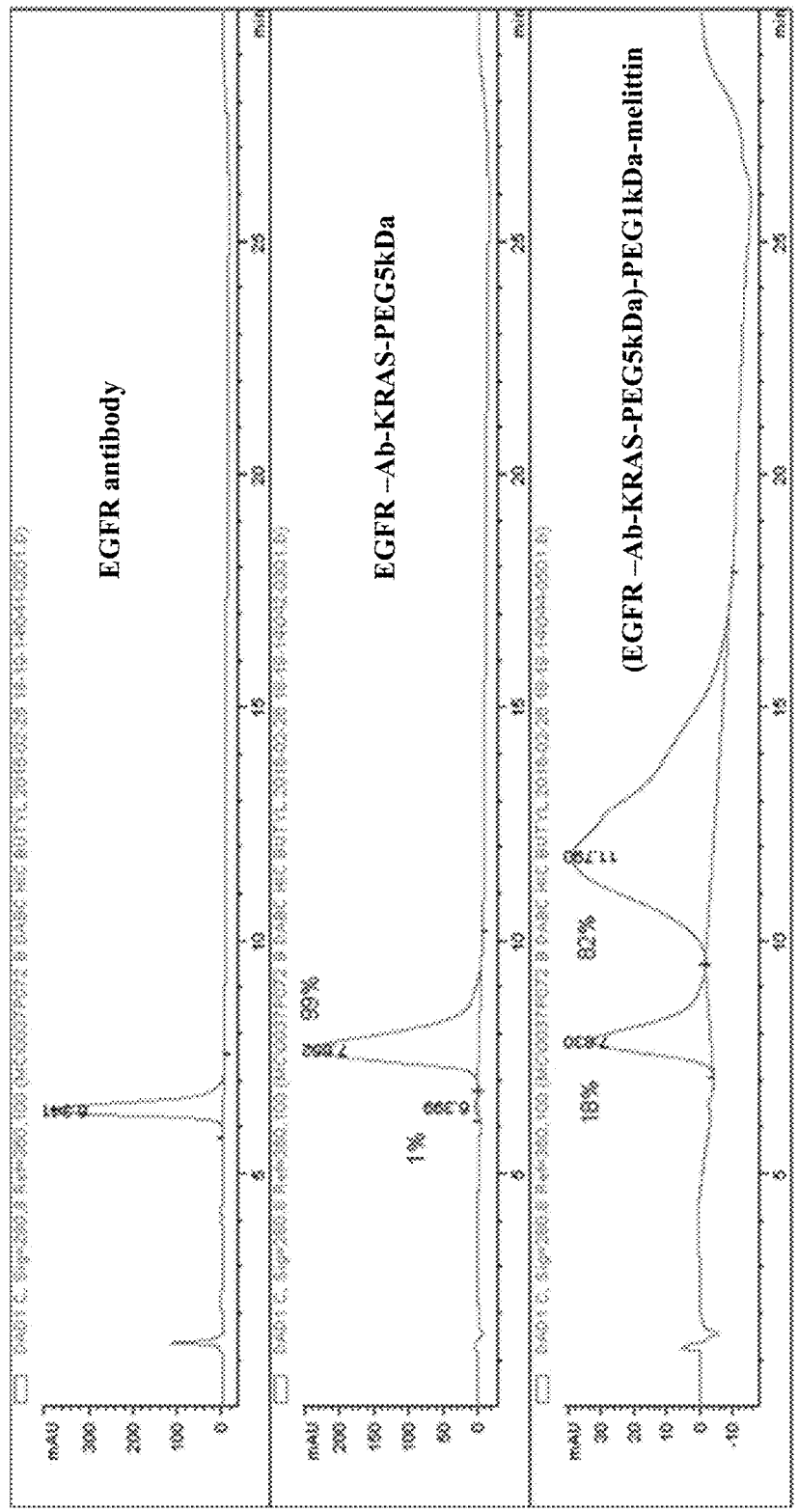
FIG. 20 illustrates Melittin-PEG1kDa-(EGFR antibody-KRAS-PEG5kDa).

FIG. 19 shows INF7-PEG1kDa-(EGFR antibody-KRAS-PEG5kDa). FIG. 20 shows Melittin-PEG1kDa-(EGFR antibody-KRAS-PEG5kDa).

Example 8: In Vivo Pharmacokinetics Study of a EGFR Antibody-siRNA-PEG Conjugate (PK-055)

Groups (n=3) of female NCr nu/nu mice bearing subcutaneous flank H358 tumors 100-150 mm$^3$ in volume were treated with one intravenous (i.v.) tail vein injection of siRNA conjugate, while control groups (n=4) of the same mice received one i.v. injection of PBS as a vehicle control. Treatment groups that received EGFR antibody-siRNA-PEG conjugates were dosed at 0.5 mg/kg (based on the weight of siRNA) and groups that received cholesterol-siRNA conjugates were dosed at 15 mg/kg. All groups (treatments and controls) were administered a dose volume of 5 mL/kg. Non-terminal blood samples were collected at 2, 15, or 60 minutes post-dose via puncture of the retro-orbital plexus and centrifuged to generate plasma for PK analysis. Mice were sacrificed by CO$_2$ asphyxiation at 24, 96, or 168 h post-dose. Table 21 describes the study design in more detail and provides a cross-reference to the conjugate synthesis and characterization. Terminal blood samples were collected via cardiac puncture and processed to generate plasma for PK analysis. 50 mg pieces of tumor, liver, kidney, and lung were collected and snap-frozen in liquid nitrogen. mRNA knockdown analysis and siRNA quantitation were performed as described in Examples 2-7.

TABLE 21

Study design for a EGFR antibody-siRNA-PEG Conjugate (PK-055) with a cross-reference to the synthesis and characterization of the conjugates tested.

| Group | Test Article | N | siRNA Dose (mg/kg) | siRNA: EGFR-Ab Ratio (mol/mol) | melittin: siRNA Ratio (mol/mol) | ROA | Dose Schedule | Survival Bleed (min) | Terminal Bleed (h) | Harvest Time (h) | Cross-reference to synthesis and characterization |
|---|---|---|---|---|---|---|---|---|---|---|---|
| 4 | EGFR- | 3 | 0.5 | 1.4 | — | IV | t = 0 | 2 | 24 | 24 | Example 3 |
| 5 | Ab- | 3 | 0.5 | 1.4 | — | IV | t = 0 | 15 | 96 | 96 | |
| 6 | PEG10k-EGFR | 3 | 0.5 | 1.4 | — | IV | t = 0 | 60 | 168 | 168 | |
| 7 | EGFR- | 3 | 0.5 | 1.25 | — | IV | t = 0 | 2 | 24 | 24 | Example 3 |
| 8 | Ab- | 3 | 0.5 | 1.25 | — | IV | t = 0 | 15 | 96 | 96 | |
| 9 | PEG5k-EGFR | 3 | 0.5 | 1.25 | — | IV | t = 0 | 60 | 168 | 168 | |
| 10 | EGFR- | 3 | 0.5 | 1.25 | — | IV | t = 0 | 2 | 24 | 24 | Example 3 |
| 11 | Ab- | 3 | 0.5 | 1.25 | — | IV | t = 0 | 15 | 96 | 96 | |
| 12 | PEG1k-EGFR | 3 | 0.5 | 1.25 | — | IV | t = 0 | 60 | 168 | 168 | |
| 13 | EGFR- | 3 | 0.5 | 1.3 | — | IV | t = 0 | 2 | 24 | 24 | Example 3 |
| 14 | Ab- | 3 | 0.5 | 1.3 | — | IV | t = 0 | 15 | 96 | 96 | |

TABLE 21-continued

Study design for a EGFR antibody-siRNA-PEG Conjugate (PK-055) with a cross-reference to the synthesis and characterization of the conjugates tested.

| Group | Test Article | N | siRNA Dose (mg/kg) | siRNA:EGFR-Ab Ratio (mol/mol) | melittin:siRNA Ratio (mol/mol) | ROA | Dose Schedule | Survival Bleed (min) | Terminal Bleed (h) | Harvest Time (h) | Cross-reference to synthesis and characterization |
|---|---|---|---|---|---|---|---|---|---|---|---|
| 15 | EGFR-Ab-KRAS-PEG5k (n = 2 siRNAs per EGFR-Ab) | 3 | 0.5 | 1.3 | — | IV | t = 0 | 60 | 168 | 168 | |
| 16 | | 3 | 0.5 | 2.6 | — | IV | t = 0 | 2 | 24 | 24 | Example 4 |
| 17 | | 3 | 0.5 | 2.6 | — | IV | t = 0 | 15 | 96 | 96 | |
| 18 | | 3 | 0.5 | 2.6 | — | IV | t = 0 | 60 | 168 | 168 | |
| 19 | EGFR-Ab-KRAS-PEG5k (n = 1 siRNA per EGFR-Ab) | 3 | 0.5 | 1.0 | — | IV | t = 0 | 2 | 24 | 24 | Example 4 |
| 20 | | 3 | 0.5 | 1.0 | — | IV | t = 0 | 15 | 96 | 96 | |
| 21 | | 3 | 0.5 | 1.0 | — | IV | t = 0 | 60 | 168 | 168 | |
| 22 | EGFR-Ab-KRAS-PEG5k (n = 1) + EGFR-Ab-melittin | 3 | 0.5 | 1.0 | 1:1 | IV | t = 0 | 2 | 24 | 24 | Example 4 and 6 |
| 23 | | 3 | 0.5 | 1.0 | 1:1 | IV | t = 0 | 15 | 96 | 96 | |
| 24 | | 3 | 0.5 | 1.0 | 1:1 | IV | t = 0 | 60 | 168 | 168 | |
| 25 | Chol-EGFR-333mfm | 3 | 15 | — | — | IV | t = 0 | 2 | 24 | 24 | General experimental (Example 2) |
| 26 | | 3 | 15 | — | — | IV | t = 0 | 15 | 96 | 96 | |
| 27 | | 3 | 15 | — | — | IV | t = 0 | 60 | 168 | 168 | |
| 28 | Chol-KRAS-237ffm | 3 | 15 | — | — | IV | t = 0 | 2 | 24 | 24 | General experimental (Example 2) |
| 29 | | 3 | 15 | — | — | IV | t = 0 | 15 | 96 | 96 | |
| 30 | | 3 | 15 | — | — | IV | t = 0 | 60 | 168 | 168 | |
| 31 | Vehicle | 4 | — | — | — | IV | t = 0 | — | — | 24 | |
| 32 | | 4 | — | — | — | IV | t = 0 | — | — | 96 | |
| 33 | | 4 | — | — | — | IV | t = 0 | — | — | 168 | |

Figure 21:
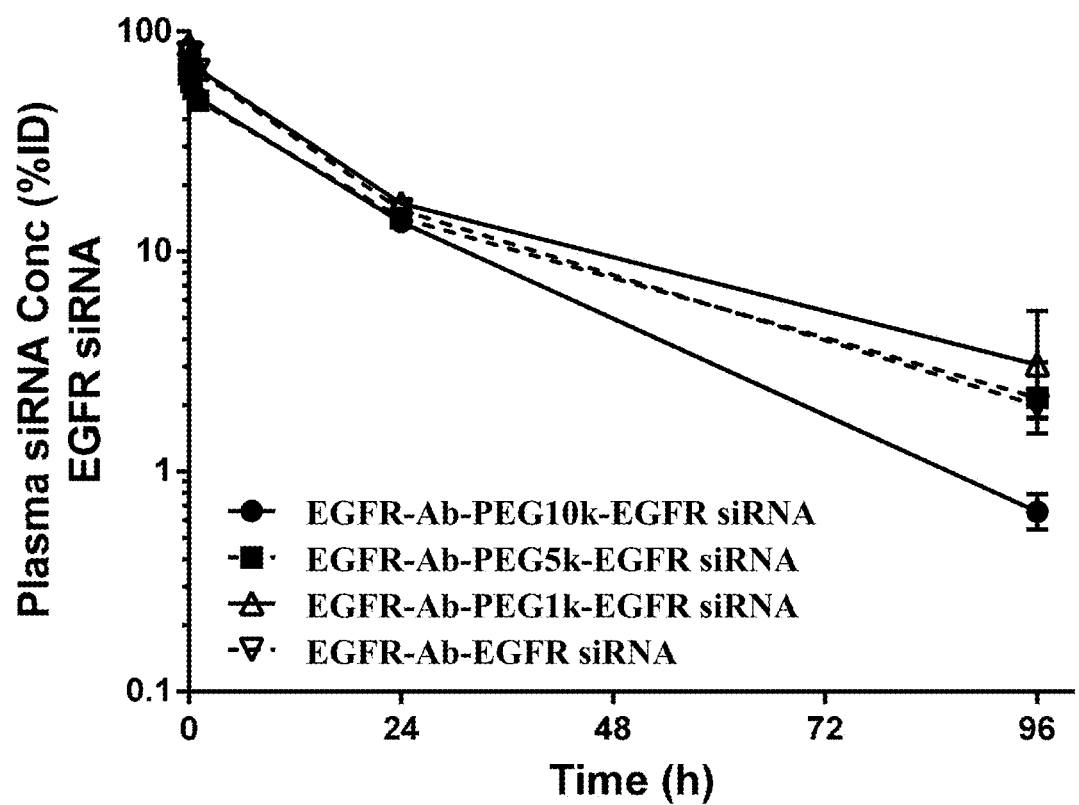
FIG. 21 illustrates plasma concentration-time profiles out to 96 h post-dose with the siRNA concentration expressed as a percent of injected dose (% ID).
Figure 22:
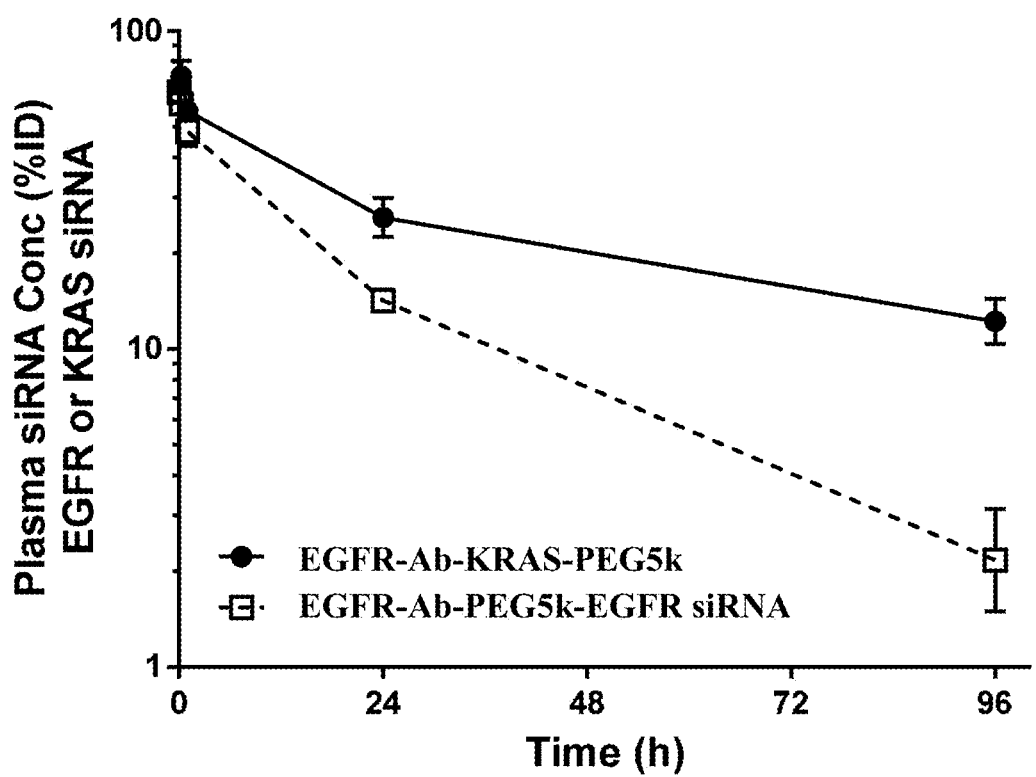
FIG. 22 shows plasma concentration-time profiles out to 96 h post-dose with the siRNA concentration expressed as a percent of injected dose (% ID).

PEG linkers of various molecular weights and a small molecule linker were used to attach EGFR siRNA to an EGFR antibody (EGFR-Ab) and the PK was assessed to determine the effect of the linker molecular weight on the behavior of the mAb-siRNA conjugate in plasma. As illustrated in FIG. 21, the molecular weight of the PEG linker does not have a large impact on the plasma PK, except for the 10 kDa PEG leads to a faster siRNA clearance (i.e. lower plasma concentrations at later times). The orientation of the siRNA and PEG relative to the EGFR-Ab was also explored. As illustrated in FIG. 22, having the siRNA in between the EGFR-Ab and the PEG5k (EGFR antibody-KRAS-PEG5k) results in significantly higher plasma concentrations than the alternative conjugate where PEG5k is in between the EGFR-Ab and the siRNA (EGFR antibody-PEG5k-EGFR). In some instances, the use of two different siRNAs on these conjugates does not impact the plasma kinetics.

Figure 23:
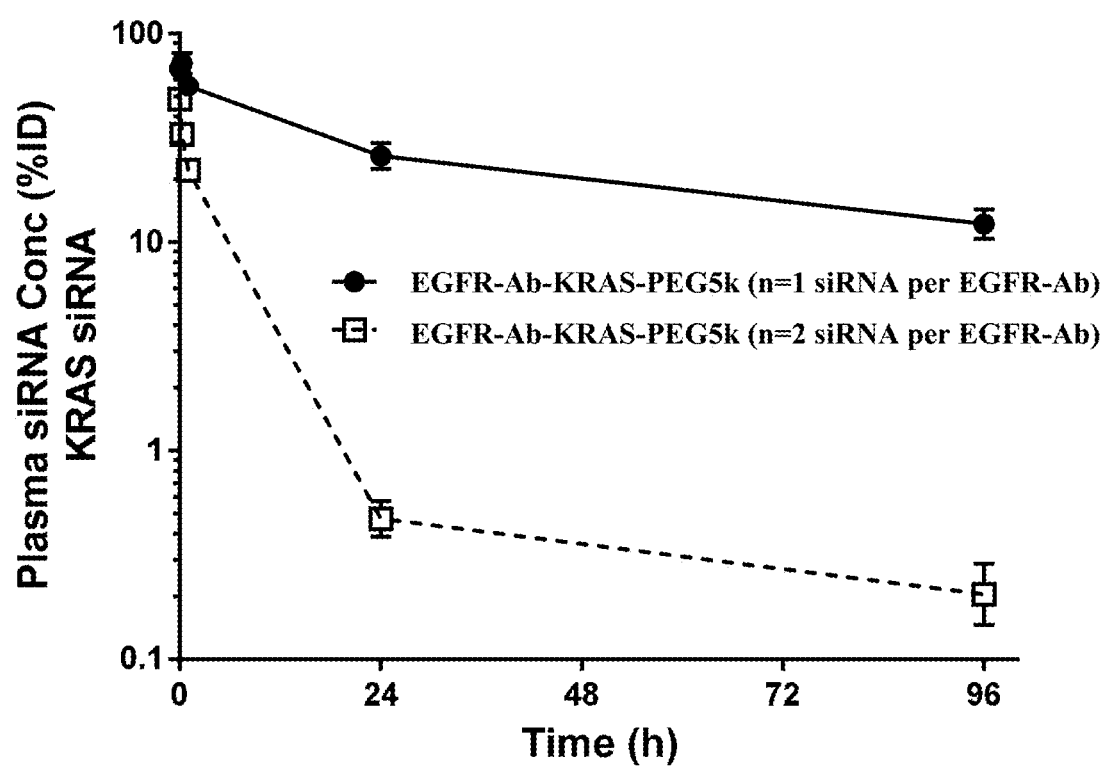
FIG. 23 shows plasma concentration-time profiles out to 96 h post-dose with the siRNA concentration expressed as a percent of injected dose (% ID).
Figure 24:
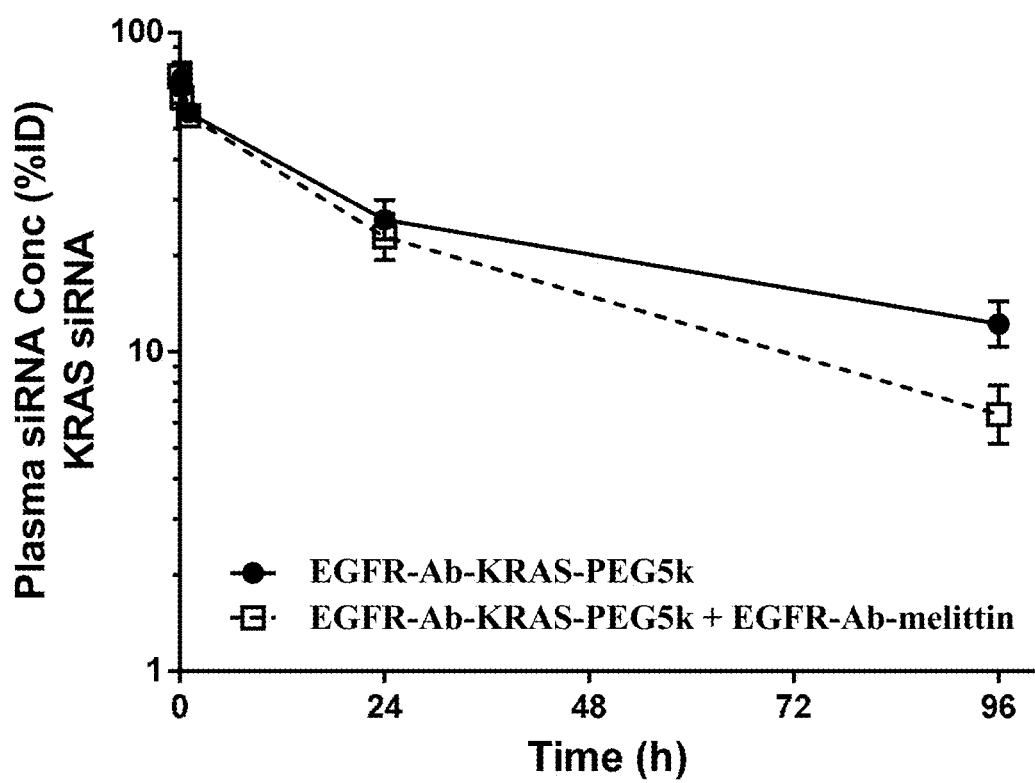
FIG. 24 illustrates plasma concentration-time profiles out to 96 h post-dose with the siRNA concentration expressed as a percent of injected dose (% ID).

The drug loading on the EGFR-Ab was also investigated, with n=1 and n=2 siRNAs per EGFR-Ab. As illustrated in FIG. 23, having only one siRNA per EGFR-Ab resulted in much higher plasma concentrations, whereas the higher loading of n=2 siRNA per EGFR-Ab resulted in faster clearance from plasma. The impact of adding an endosomal escape peptide (melittin) was assessed. EGFR antibody-KRAS-PEG5k and EGFR antibody-melittin were mixed together in solution and co-injected. As illustrated in FIG. 24, the presence of EGFR antibody-melittin increases the clearance from plasma of EGFR antibody-KRAS-PEG5k at later times.

Figure 25:
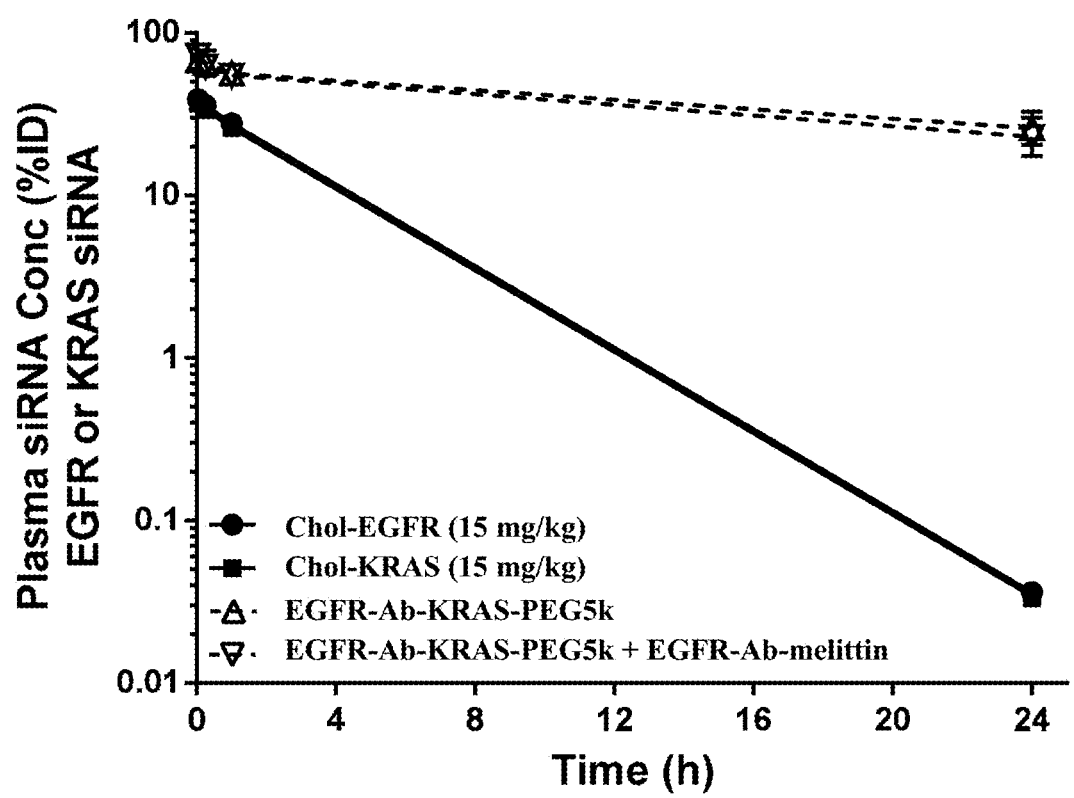
FIG. 25 illustrates plasma concentration-time profiles out to 24 h post-dose with the siRNA concentration expressed as a percent of injected dose (% ID).

The plasma PK of cholesterol-siRNA conjugates was next compared to the mAb-siRNA conjugates after intravenous administration via tail vein injection. As illustrated in FIG. 25, the chol-siRNA conjugates are cleared much faster from plasma than the mAb-siRNA conjugates. As illustrated from the PK profile, having either EGFR or KRAS siRNA on the conjugate did not affect the plasma kinetics.

Figure 26A:
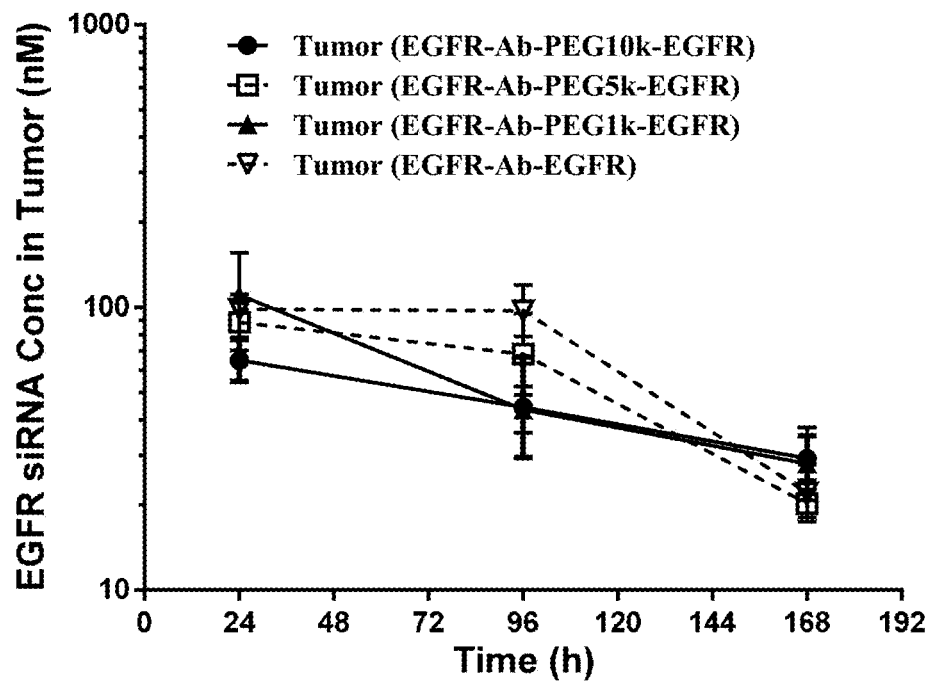
FIG. 26A and FIG. 26B illustrate tissue concentration-time profiles in tumor or normal livers of mice.
Figure 26B:
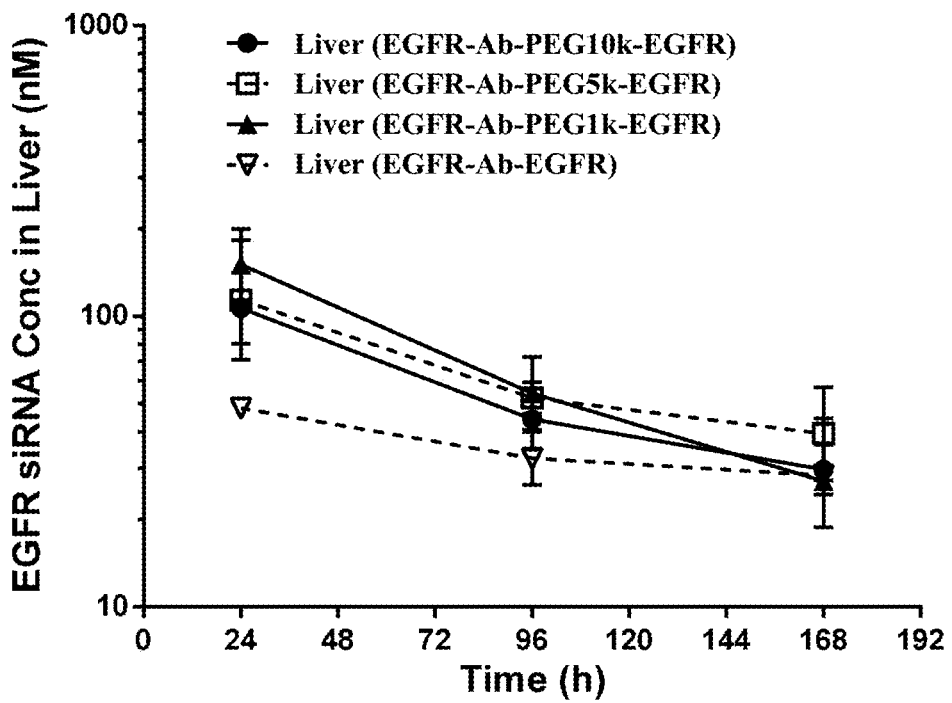

In addition to the plasma PK analysis, siRNA concentrations were determined in tissues at various times post-dose to determine the tissue PK. Tissue concentrations were measured pmol/g and then converted to pmol/mL by assuming the density of tissue equals 1 g/mL. In FIG. 26, a concentration of 1 nM=1 nmol/L=1 pmol/mL=1 pmol/g tissue. As illustrated in FIG. 26A, a single i.v. dose of 0.5 mg/kg of EGFR antibody-siRNA resulted in approximately 100 nM concentrations of siRNA in tumor at 24 h post-dose for virtually all of the conjugates. In the case of these EGFR antibody-linker-siRNA conjugates, the molecular weight of the linker between the EGFR-Ab and the EGFR siRNA does not seem to alter the PK of these conjugates in the s.c. flank H358 tumors. As illustrated in FIG. 26B, the concentration of siRNA in liver following a single i.v. dose of 0.5 mg/kg of EGFR antibody-siRNA is approximately 100 nM at 24 h post-dose, similar to that seen in tumor. Only the small molecule linker at 24 h post-dose produces a siRNA concentration in liver approximately half of what is seen with longer PEG linkers. siRNA concentrations decrease over time in both tumor and liver tissue with these EGFR antibody-linker-siRNA conjugates.

Figure 27:
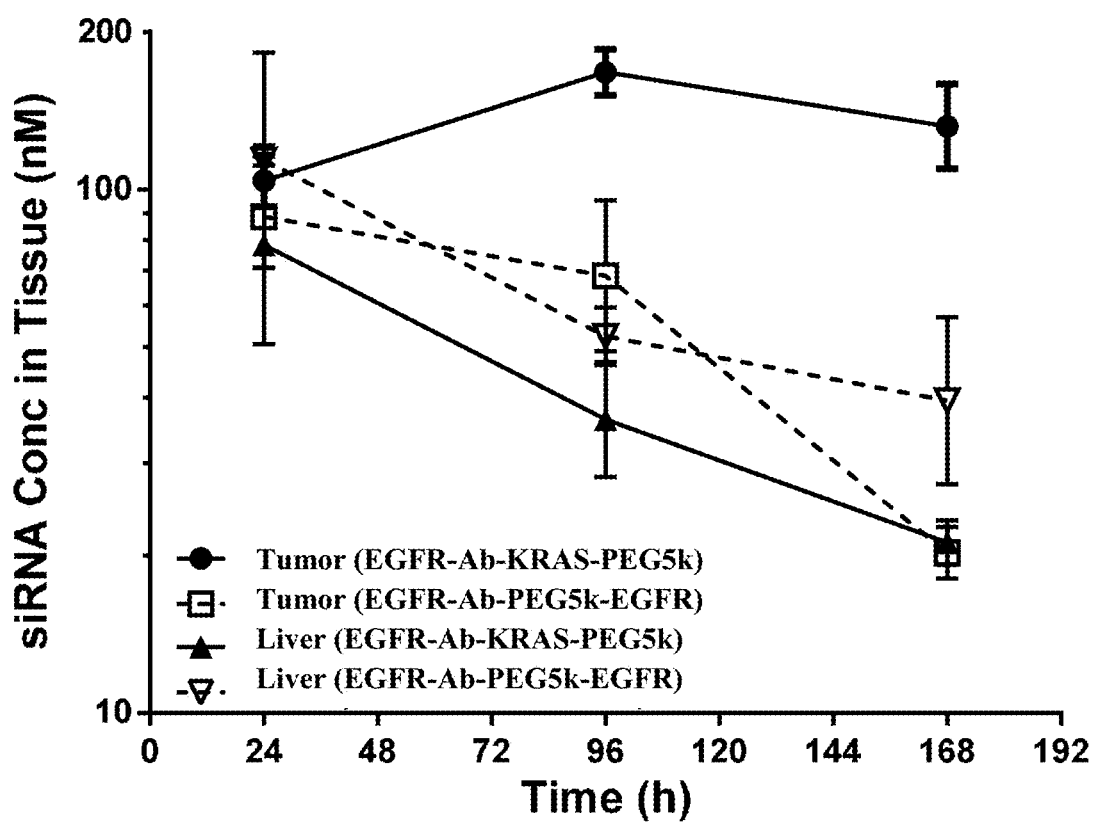
FIG. 27 shows tissue concentration-time profiles out to 168 h post-dose measured in s.c. flank H358 tumors and normal livers of mice.
Figure 28:
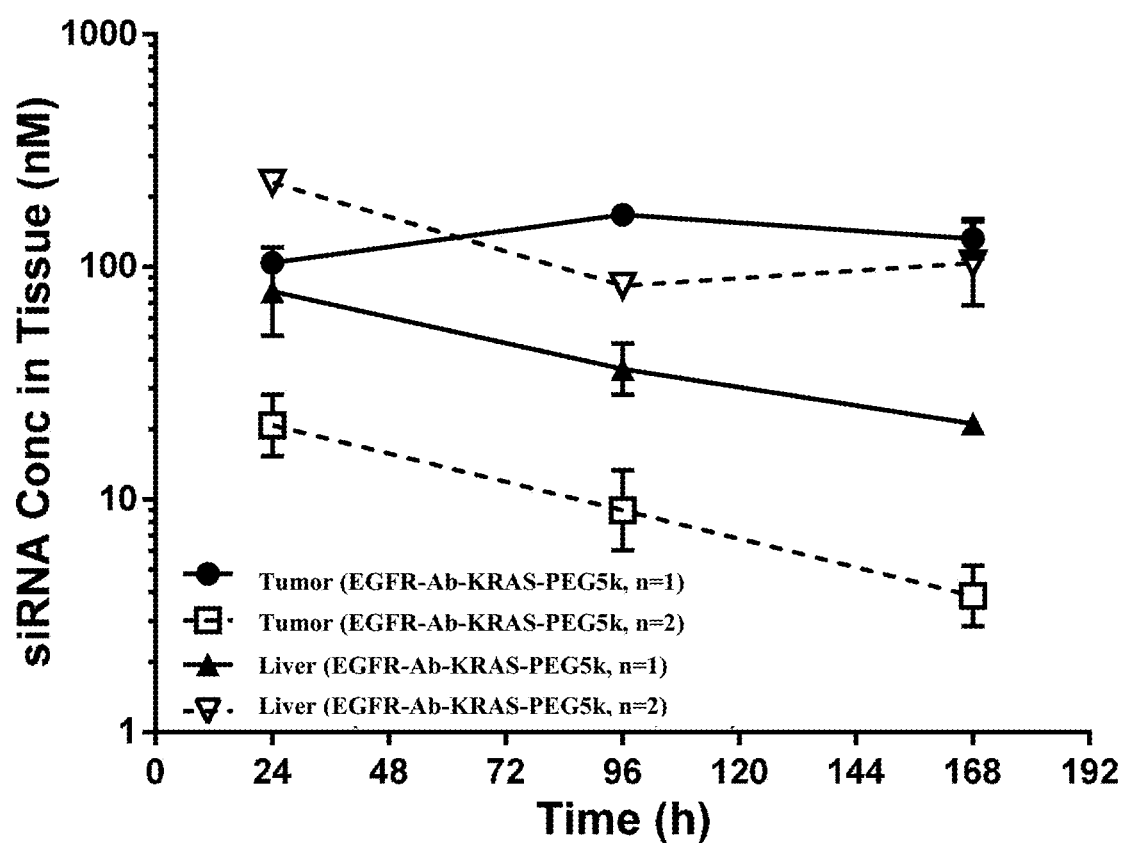
FIG. 28 illustrates tissue concentration-time profiles out to 168 h post-dose measured in s.c. flank H358 tumors and normal livers of mice.
Figure 29:
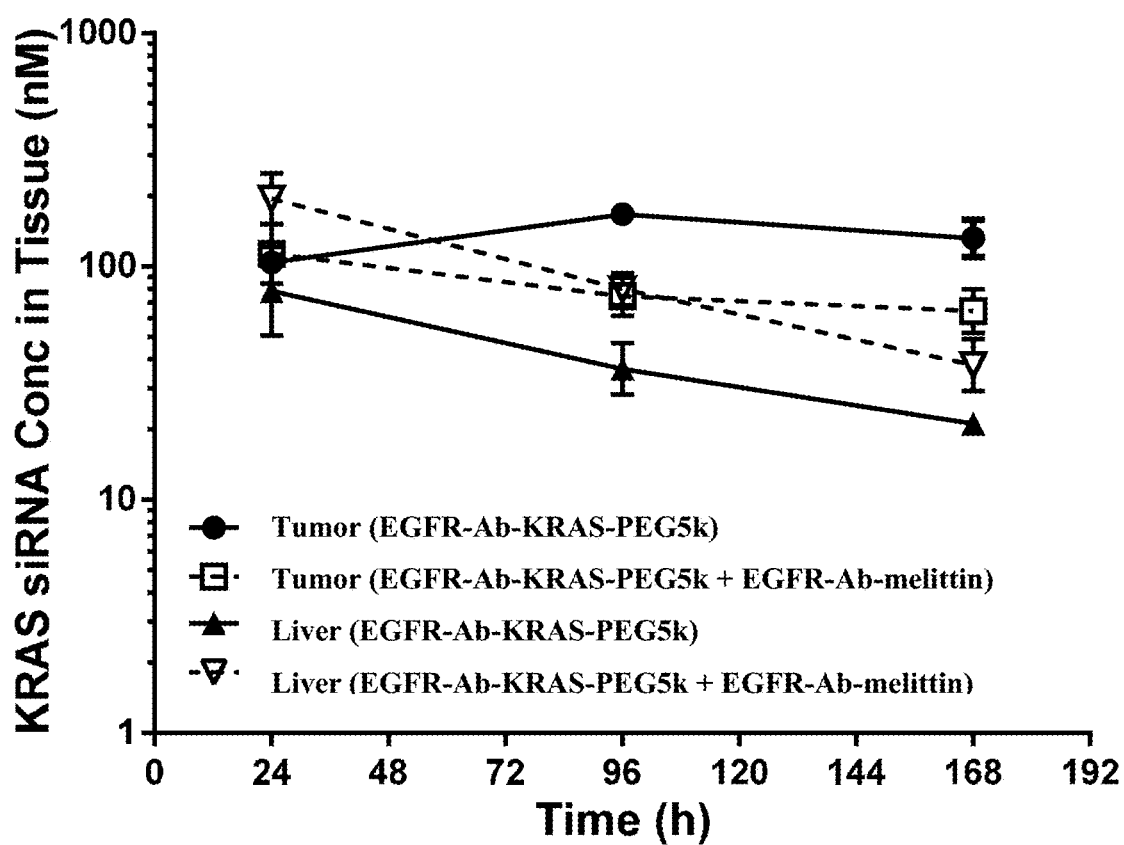
FIG. 29 illustrates tissue concentration-time profiles out to 168 h post-dose measured in s.c. flank H358 tumors and normal livers of mice.

The orientation of the siRNA and PEG relative to the EGFR-Ab was also explored relative to the tissue PK profiles. As illustrated in FIG. 27, both the EGFR antibody-KRAS-PEG5k and the EGFR antibody-PEG5k-EGFR conjugates deliver approximately 100 nM siRNA into both tumor and liver following a single i.v. dose of 0.5 mg/kg. However, while the EGFR antibody-KRAS-PEG5k maintains the siRNA concentration in tumor at approximately 100 nM until 168 h post-dose, the other 3 curves decline in concentration over time. Next, the tissue PK as a function of drug loading was assessed. As illustrated from FIG. 28, n=1 siRNA per EGFR-Ab delivered higher amounts of siRNA into tumor compared to liver. However, increasing the siRNA loading to n=2 siRNA per EGFR-Ab increased the amount of siRNA delivered to liver and decreased the amount of siRNA delivered to tumor. Additionally, EGFR antibody-melittin was mixed with some formulations in order to introduce endosomal escape functionality. As illustrated from FIG. 29, mixing and co-administering EGFR antibody-melittin with EGFR antibody-siRNA did not have a large impact on the tissue PK. The addition of melittin decreased uptake of siRNA in tumor and increased the uptake of siRNA in liver.

The tissue PK profiles of cholesterol-siRNA conjugates (using both EGFR and KRAS siRNA) in liver and in s.c. flank H358 tumors was also assessed. As illustrated from FIG. 30, both chol-siRNA conjugates delivered approximately 5 μM concentrations of siRNA into liver 24 h following a single i.v. dose of 15 mg/kg. In liver, the chol-KRAS appears to clear slightly faster than the chol-EGFR on the !-week time scale. The two different chol-siRNA conjugates further show different PK profiles in tumor. Both cholesterol conjugates deliver less siRNA into tumor compared to liver, but the chol-EGFR delivers more siRNA into tumor when compared to the chol-KRAS conjugate. Both chol-siRNA conjugates are cleared from tumor over time and with a similar slope.

Figure 30:
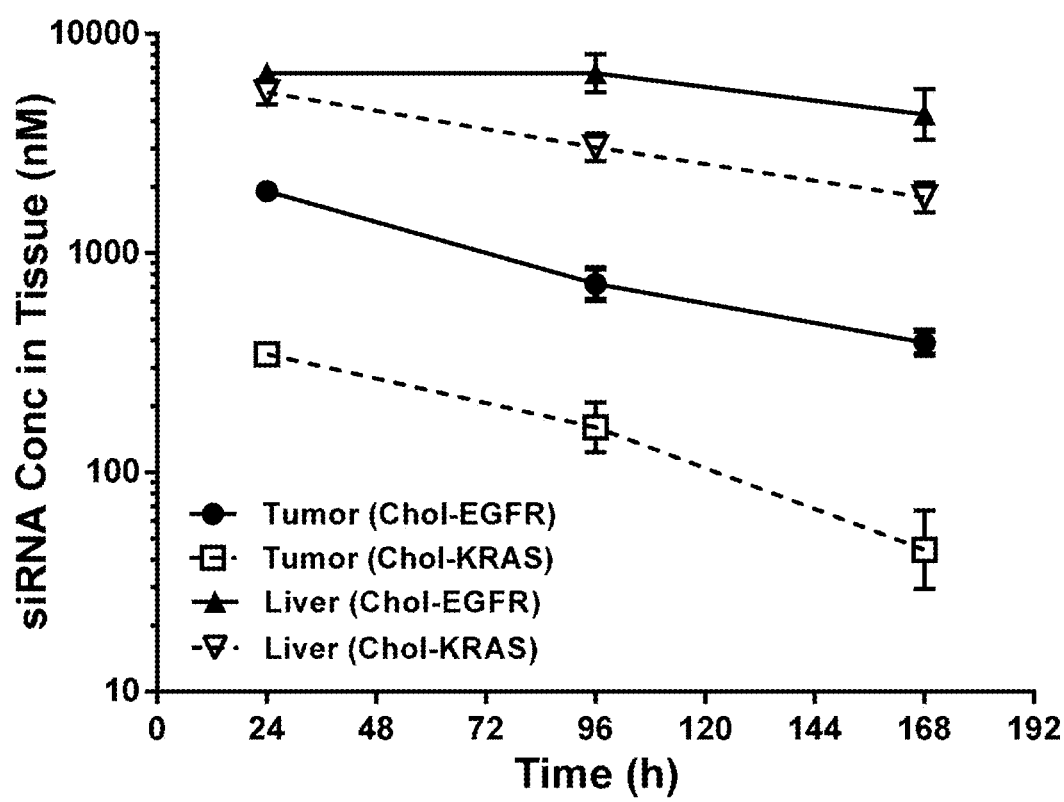
FIG. 30 shows tissue concentration-time profiles out to 168 h post-dose measured in s.c. flank H358 tumors and normal livers of mice.
Figure 31A:
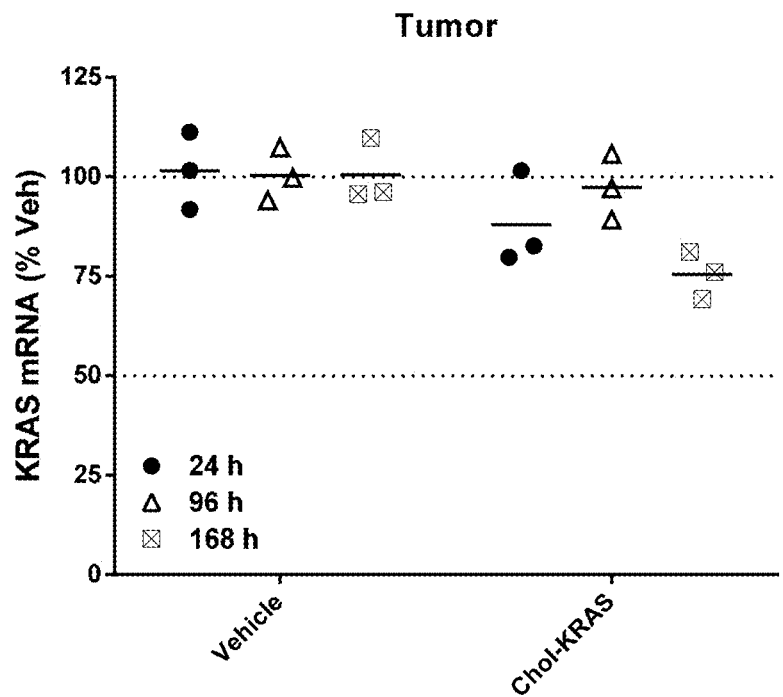
FIG. 31A and FIG. 31B illustrate siRNA-mediated mRNA knockdown of human KRAS in human s.c. flank H358 tumors (FIG. 31A) or mouse KRAS in normal mouse liver (FIG. 31B).
Figure 31B:
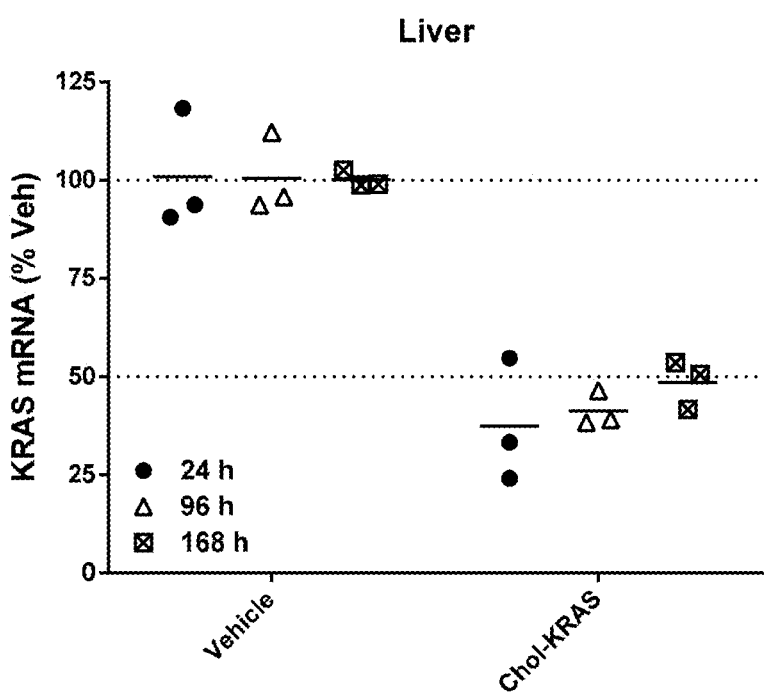
Figure 32:
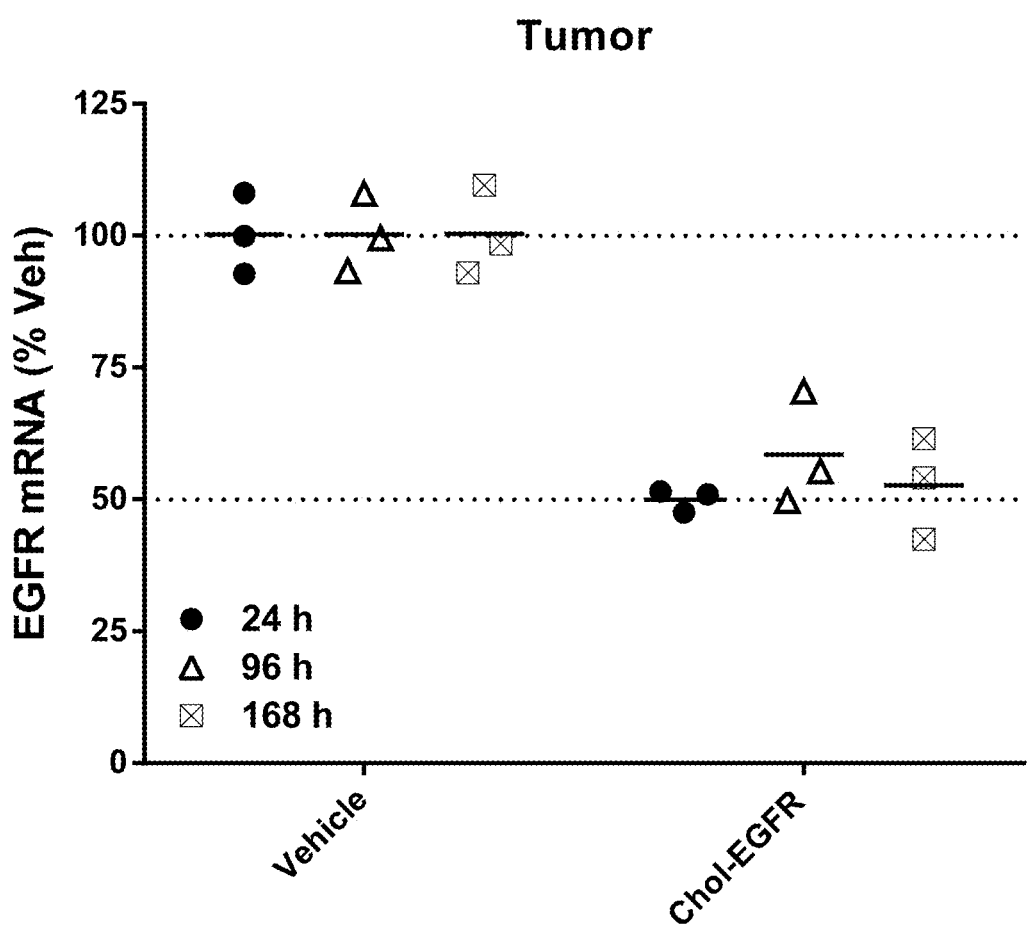
FIG. 32 illustrates siRNA-mediated mRNA knockdown of human EGFR in human s.c. flank H358 tumors.
Figure 33:
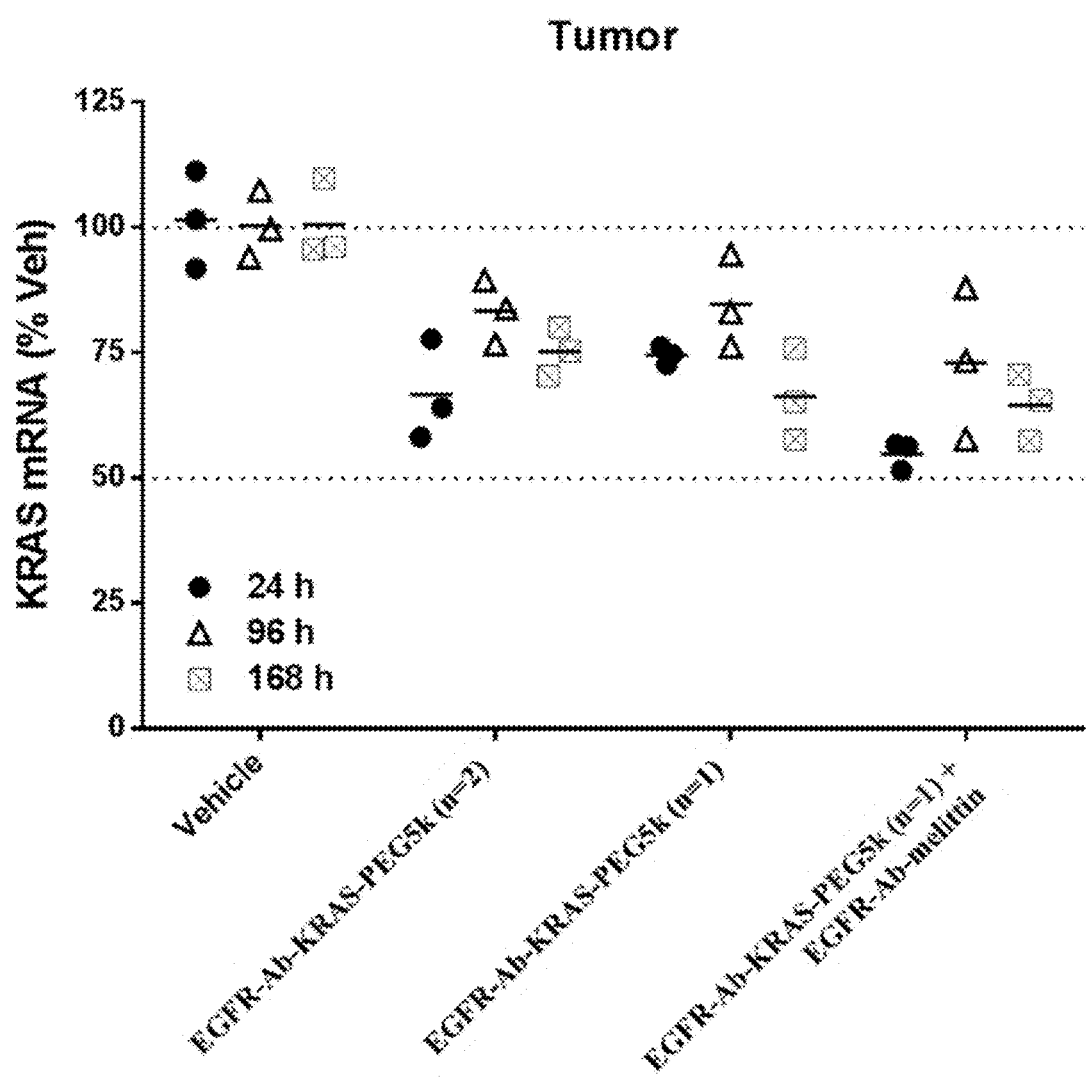
FIG. 33 illustrates siRNA-mediated mRNA knockdown of human KRAS in human s.c. flank H358 tumors.
Figure 34:
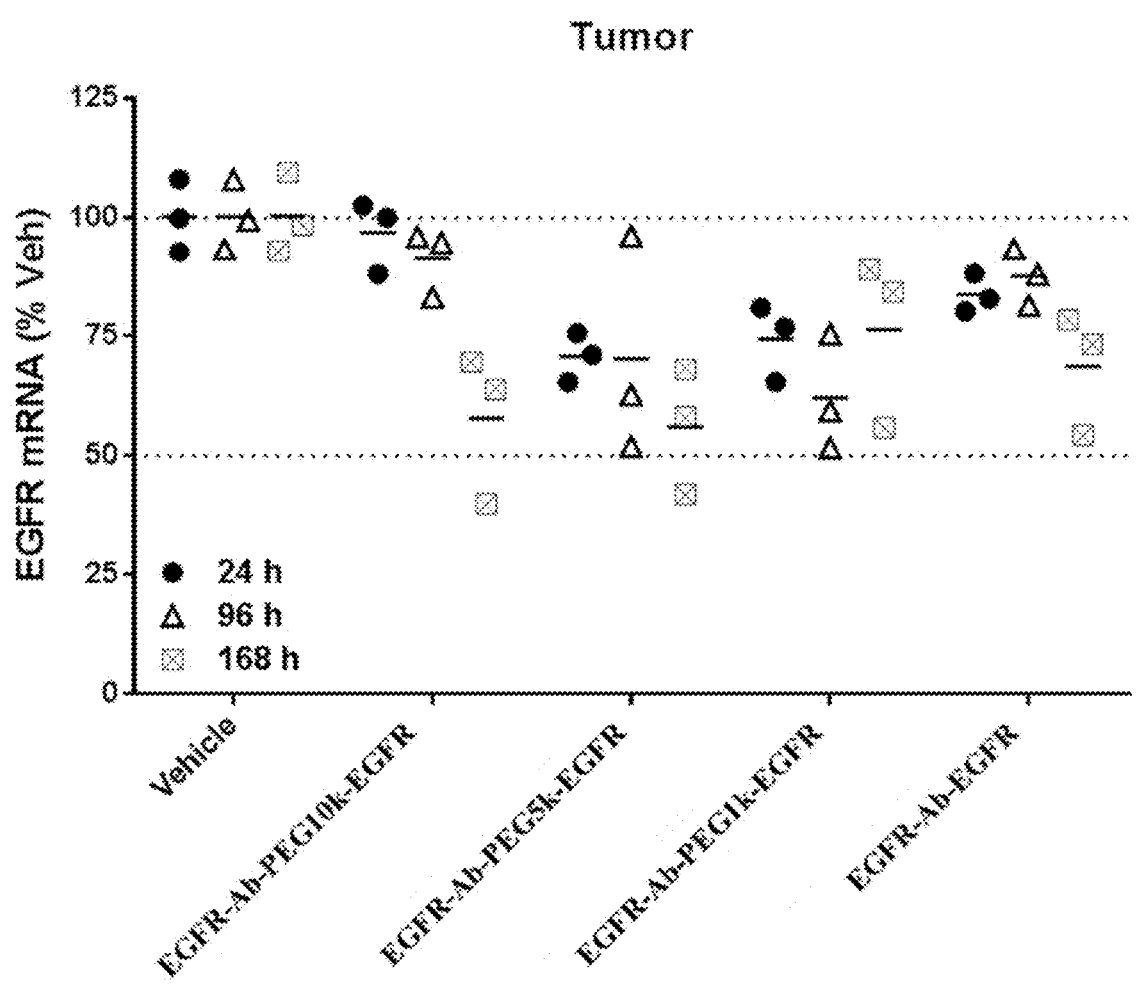
FIG. 34 illustrates siRNA-mediated mRNA knockdown of human EGFR in human s.c. flank H358 tumors.

A PD analysis followed the PK analysis. As illustrated in FIG. 31A, the chol-KRAS conjugate produced only marginal (~25%) mRNA knockdown of the KRAS target gene in tumor following a single i.v. dose of 15 mg/kg. However, as illustrated in FIG. 31B, the same 15 mg/kg dose of chol-KRAS was able to produce >50% mRNA knockdown in the mouse liver. The chol-EGFR conjugate was able to produce >50% mRNA knockdown in tumor, as illustrated in FIG. 32. In some instances, the higher knockdown with chol-EGFR in tumor compared to chol-KRAS is due to the higher siRNA concentrations observed in tumor with chol-EGFR compared to chol-KRAS (FIG. 30). Finally, as illustrated in FIGS. 33 and 34, most of the EGFR antibody-siRNA conjugates resulted in approximately 25-50% EGFR or KRAS mRNA knockdown in tumors after a single IV dose, but at a much lower dose (0.5 mg/kg) compared to the chol-siRNA conjugates.

Figure 93:
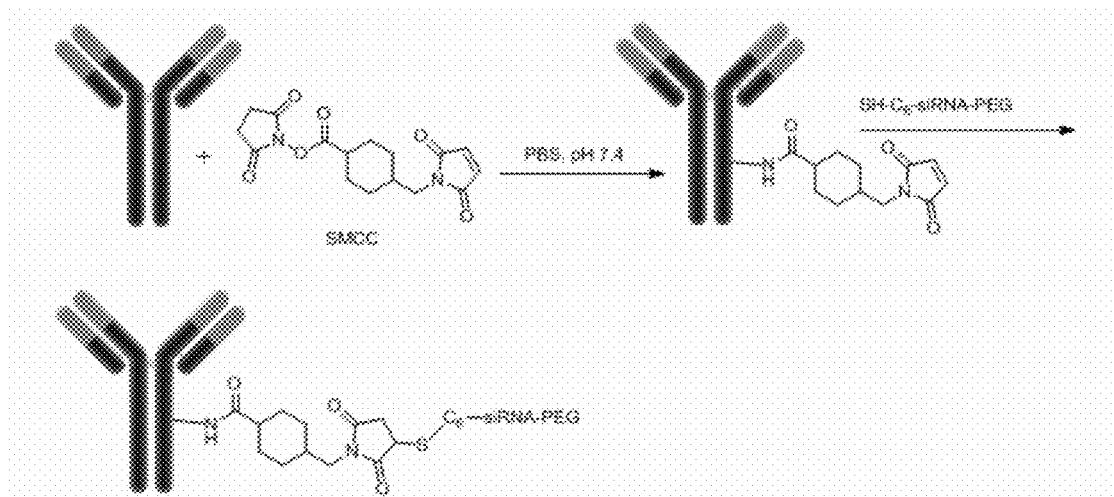
FIG. 93 illustrates Conjugation scheme 6.

Example 9: Synthesis, Purification and Analysis of Additional Antibody-siRNA Conjugates Scheme-6: Antibody-Lys-siRNA-PEG Conjugates Via Antibody Lysine Conjugation of SMCC Linker Step 1: Antibody Conjugation with SMCC Linker Followed by SH-siRNA Antibody was buffer exchanged with 1× Phosphate buffer (pH 7.4) and made up to 10 mg/ml concentration. To this solution, 2 equivalents of SMCC linker dissolved in DMSO was added and rotated for 4 hours at room temperature. Unreacted SMCC linker was removed by spin filtration using 50 kDa MWCO Amicon spin filters and PBS pH 7.4. The antibody-maleimide conjugate was collected into a reaction vessel and SH-C6-siRNA or SH-C6-siRNA-C6-NHCO-PEG-XkDa (2 equivalents) (X=0.5 kDa to 10 kDa) was added at RT in pH 7.4 PBS with 5 mM EDTA and rotated overnight. See FIG. 93. Analysis of the reaction mixture by analytical SAX column chromatography method-2 showed antibody siRNA conjugate along with unreacted antibody and siRNA.

Step 2: Purification

The crude reaction mixture was purified by AKTA explorer FPLC using anion exchange chromatography method-1. Fractions containing DAR1 and DAR>2 antibody-siRNA-PEG conjugates were separated, concentrated and buffer exchanged with pH 7.4 PBS.

Step-3: Analysis of the Purified Conjugate

The isolated conjugates were characterized by SAX chromatography, SEC chromatography and SDS-PAGE analysis. The purity of the conjugate was assessed by analytical HPLC using either anion exchange chromatography method-2. All DAR1 conjugate generally eluted at 9.0±0.4 minutes while the DAR2 and DAR3 conjugates generally eluted at 9.7±0.2 minutes. Typical DAR1 conjugate is greater than 90% pure after purification while typical DAR>2 lysine conjugates contains 70-80% DAR2 and 20-30% DAR3.

Scheme-7: Antibody-Cys-siRNA-PEG Conjugates Via Antibody Cysteine Conjugation

Step 1: Antibody Interchain Disulfide Reduction with TCEP

Figure 94:
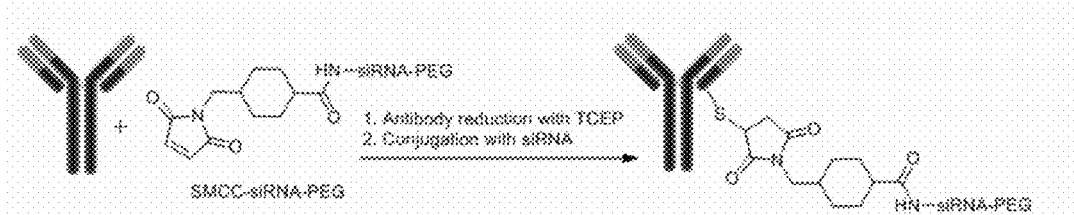
FIG. 94 illustrates Conjugation scheme 7.

Antibody was buffer exchanged with borax buffer (pH 8) and made up to 10 mg/ml concentration. To this solution, 2 equivalents of TCEP in water was added and rotated for 2 hours at RT. The resultant reaction mixture was buffer exchanged with pH 7.4 PBS containing 5 mM EDTA and added to a solution of SMCC-C6-siRNA or SMCC-C6-siRNA-C6-NHCO-PEG-XkDa (2 equivalents) (X=0.5 kDa to 10 kDa) in pH 7.4 PBS containing 5 mM EDTA at RT and rotated overnight. Analysis of the reaction mixture by analytical SAX column chromatography showed antibody siRNA conjugate along with unreacted antibody and siRNA. See FIG. 94

Step 2: Purification

The crude reaction mixture was purified by AKTA explorer FPLC using anion exchange chromatography method-1. Fractions containing DAR1 and DAR>2 antibody-PEG-siRNA conjugates were separated, concentrated and buffer exchanged with pH 7.4 PBS.

Step-3: Analysis of the Purified Conjugate

The isolated conjugates were characterized by SEC, SAX chromatography and SDS-PAGE.

The purity of the conjugate was assessed by analytical HPLC using either anion exchange chromatography method-2 or anion exchange chromatography method-3. Isolated DAR1 conjugates are typically eluted at 9.0+0.3 min on analytical SAX method-2 and are greater than 90% pure. The typical DAR>2 cysteine conjugate contains more than 85% DAR2 and less than 15% DAR3.

Figure 95:
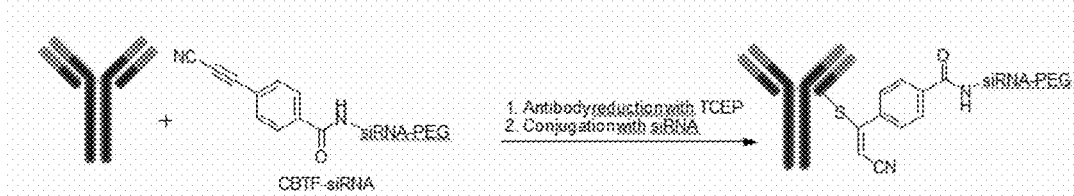
FIG. 95 illustrates Conjugation scheme 8.

Scheme-8: Antibody siRNA Conjugates Via Antibody Inter-Chain Cysteine Conjugation Step 1: Antibody Interchain Disulfide Reduction with TCEP Antibody was buffer exchanged with borax buffer (pH 8) and made up to 10 mg/ml concentration. To this solution, 2 equivalents of TCEP in water was added and rotated for 2 hours at RT. The resultant reaction mixture was buffer exchanged with pH 7.4 PBS containing 5 mM EDTA and added to a solution of CBTF-C6-siRNA-C6-NHCO-PEG-5kDa (2 equivalents) in pH 7.4 PBS containing 5 mM EDTA at RT and rotated overnight. Analysis of the reaction mixture by analytical SAX column chromatography showed antibody siRNA conjugate along with unreacted antibody and siRNA. See FIG. 95

Step 2: Purification

The crude reaction mixture was purified by AKTA explorer FPLC using anion exchange chromatography method-1. Fractions containing DAR1 and DAR≥2 antibody-siRNA conjugates were separated, concentrated and buffer exchanged with pH 7.4 PBS. Typical DAR>2 cysteine conjugate contains greater than 85% DAR2 and less than 15% DAR3 or higher.

Step-3: Analysis of the Purified Conjugate

The isolated conjugates were characterized by either mass spec or SDS-PAGE. The purity of the conjugate was assessed by analytical HPLC using either anion exchange chromatography method-2 or anion exchange chromatography method-3.

Figure 96:
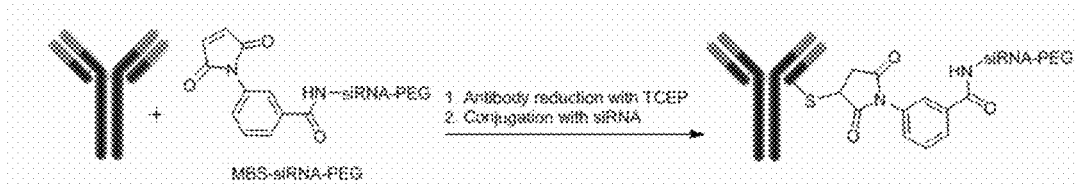
FIG. 96 illustrates Conjugation scheme 9.

Scheme-9: Antibody siRNA Conjugates Via Antibody Inter-Chain Cysteine Conjugation Step 1: Antibody Reduction with TCEP Antibody was buffer exchanged with borax buffer (pH 8) and made up to 5 mg/ml concentration. To this solution, 2 equivalents of TCEP in water was added and rotated for 2 hours at RT. The resultant reaction mixture was exchanged with pH 7.4 PBS containing 5 mM EDTA and added to a solution of MBS-C6-siRNA-C6-NHCO-PEG-5kDa (2 equivalents) in pH 7.4 PBS containing 5 mM EDTA at RT and rotated overnight. Analysis of the reaction mixture by analytical SAX column chromatography showed antibody siRNA conjugate along with unreacted antibody and siRNA. See FIG. 96

Step 2: Purification

The crude reaction mixture was purified by AKTA explorer FPLC using anion exchange chromatography method-1. Fractions containing DAR1 and DAR>2 antibody-siRNA conjugates were separated, concentrated and buffer exchanged with pH 7.4 PBS. Typical DAR>2 cysteine conjugate contains greater than 85% DAR2 and less than 15% DAR3 or higher.

Step-3: Analysis of the Purified Conjugate

The isolated conjugates were characterized by either mass spec or SDS-PAGE. The purity of the conjugate was assessed by analytical HPLC using either anion exchange chromatography method-2 or anion exchange chromatography method-3.

Figure 97:
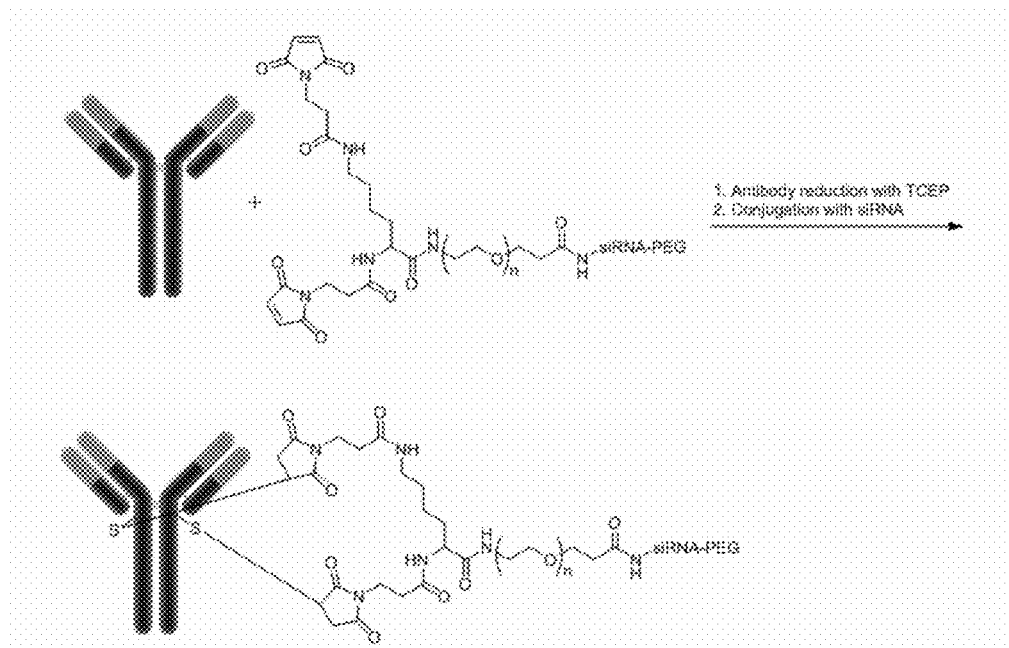
FIG. 97 illustrates Conjugation scheme 10.

Scheme-10: Antibody siRNA Conjugates Via Antibody Inter-Chain Cysteine Conjugation Step 1: Antibody Reduction with TCEP Antibody was buffer exchanged with borax buffer (pH 8) and made up to 5 mg/ml concentration. To this solution, 2 equivalents of TCEP in water was added and rotated for 2 hours at RT. The resultant reaction mixture was exchanged with pH 7.4 PBS containing 5 mM EDTA and added to a solution of MBS-C6-siRNA-C6-NHCO-PEG-5kDa (2 equivalents) in pH 7.4 PBS containing 5 mM EDTA at RT and rotated overnight. Analysis of the reaction mixture by analytical SAX column chromatography showed antibody siRNA conjugate along with unreacted antibody and siRNA. See FIG. 97

Step 2: Purification

The crude reaction mixture was purified by AKTA explorer FPLC using anion exchange chromatography method-1. Fractions containing DAR1 and DAR>2 antibody-siRNA conjugates were separated, concentrated and buffer exchanged with pH 7.4 PBS. Typical DAR>2 cysteine conjugate contains greater than 85% DAR2 and less than 15% DAR3 or higher.

Step-3: Analysis of the Purified Conjugate

The isolated conjugates were characterized by either mass spec or SDS-PAGE. The purity of the conjugate was assessed by analytical HPLC using either anion exchange chromatography method-2 or anion exchange chromatography method-3.

Scheme-11: Synthesis of Antibody-Lysine-S-S-siRNA-PEG Conjugates

Step 1: Antibody Conjugation with SPDP Linker Followed by SH-siRNA-PEG5kDa

Figure 98:
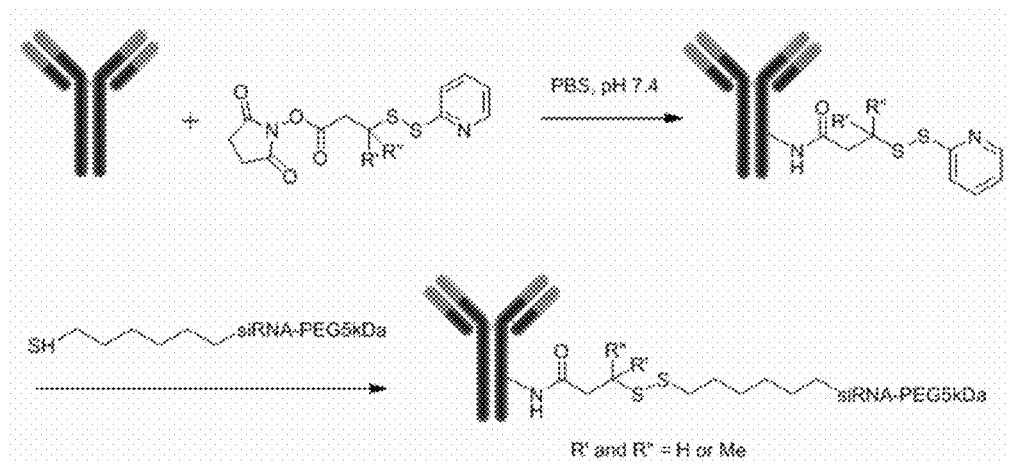
FIG. 98 illustrates Conjugation scheme 11.

Antibody was buffer exchanged with pH 7.4 1×PBS and made up to 10 mg/ml concentration. To this solution, 2 equivalents of SPDP linker [succinimidyl 3-(2-pyridyldithio)propionate] or its methylated version was added and rotated for 4 hours at room temperature. Unreacted SPDP linker was removed by spin filtration using 50 kDa MWCO Amicon spin filters and pH 7.4 PBS buffer. The retentate was collected and 2 equivalents of SH-C6-siRNA-PEG5kDa in pH 7.4 PBS was added at room temperature and rotated overnight. The reaction mixture was analyzed by analytical SAX column chromatography and the conjugate along with unreacted antibody and siRNA was seen. See FIG. 98

Step 2: Purification

The crude reaction mixture was purified by AKTA explorer FPLC using anion exchange chromatography method-1. Fractions containing DAR1 and DAR>2 antibody-siRNA conjugates were separated, concentrated and buffer exchanged with pH 7.4 PBS. Typical DAR>2 lysine conjugate contains 70 to 80% DAR2 and 20 to 30% DAR3 or higher.

Step-3: Analysis of the Purified Conjugate

The isolated conjugate was characterized by either mass spec or SDS-PAGE. The purity of the conjugate was assessed by analytical HPLC using anion exchange chromatography method-2.

Scheme-12: Synthesis of Antibody-Cysteine-S-S-siRNA-PEG Conjugates

Step 1: Antibody Reduction and Conjugation with Pyridyldithio-siRNA-PEG5kDa

Figure 99:
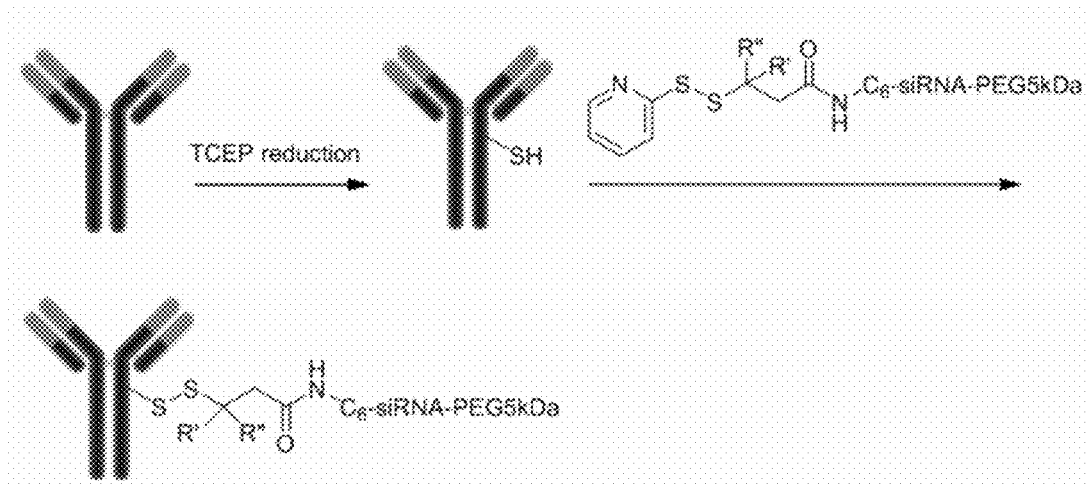
FIG. 99 illustrates Conjugation scheme 12.

Antibody was buffer exchanged with pH 8.0 borax buffer and made up to 10 mg/ml concentration. To this solution, 1.5 equivalents of TCEP was added and the reaction mixture was rotated for 1 hour at room temperature. Unreacted TCEP was removed by spin filtration using 50 kDa MWCO Amicon spin filters and buffer exchanged with pH 7.4 PBS buffer. The retentate was collected and 2 equivalents of pyridyldithio-C6-siRNA-PEG5kDa in pH 7.4 PBS was added at room temperature and rotated overnight. The reaction mixture was analyzed by analytical SAX column chromatography and conjugate along with unreacted antibody and siRNA was seen. See FIG. 99

Step 2: Purification

The crude reaction mixture was purified by AKTA explorer FPLC using anion exchange chromatography method-1. Fractions containing DAR1 and DAR>2 antibody-siRNA conjugates were separated, concentrated and buffer exchanged with pH 7.4 PBS.

Step-3: Analysis of the Purified Conjugate

Figure 100:
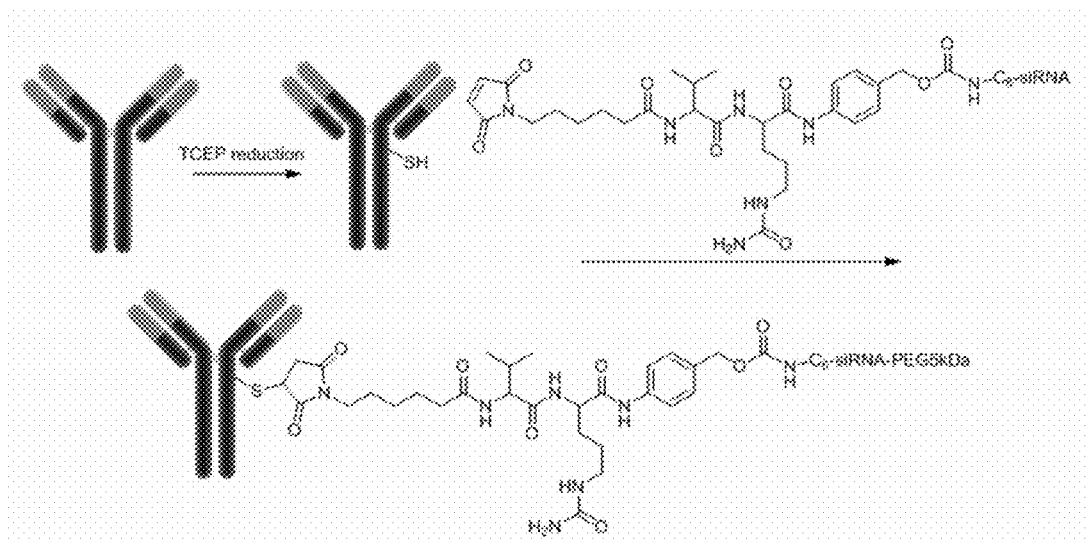
FIG. 100 illustrates Conjugation scheme 13.

The isolated conjugate was characterized by either mass spec or SDS-PAGE. The purity of the conjugate was assessed by analytical HPLC using anion exchange chro- Scheme-13: Synthesis of Antibody-Cysteine-ECL-siRNA-PEG Conjugates Step 1: Antibody Reduction and Conjugation with Maleimide-ECL-siRNA-PEG5kDa Antibody was buffer exchanged with pH 8.0 borax buffer and made up to 10 mg/ml concentration. To this solution, 1.5 equivalents of TCEP (Tris(2-carboxyethyl)phosphine hydrochloride) reagent was added and rotated for 1 hour at room temperature. Unreacted TCEP was removed by spin filtration using 50 kDa MWCO Amicon spin filters and pH 7.4 PBS buffer with 5 mM EDTA. The retentate was collected and 1.5 equivalents of maleimide-ECL-C6-siRNA-PEG5kDa in pH 7.4 PBS was added at room temperature and rotated overnight. The reaction mixture was analyzed by analytical SAX column chromatography and conjugate along with unreacted antibody and siRNA was seen. See FIG. 100

Step 2: Purification

The crude reaction mixture was purified by AKTA explorer FPLC using anion exchange chromatography method-1. Fractions containing DAR1 and DAR>2 antibody-siRNA conjugates were separated, concentrated and buffer exchanged with pH 7.4 PBS.

Step-3: Analysis of the Purified Conjugate

The isolated conjugate was characterized by either mass spec or SDS-PAGE. The purity of the conjugate was assessed by analytical HPLC using anion exchange chromatography method-2. Typical DAR>2 lysine conjugate contains 70 to 80% DAR2 and 20 to 30% DAR3 or higher.

Scheme-14: Antibody Lysine Conjugation with TCO/Tetrazine Linker

Figure 101:
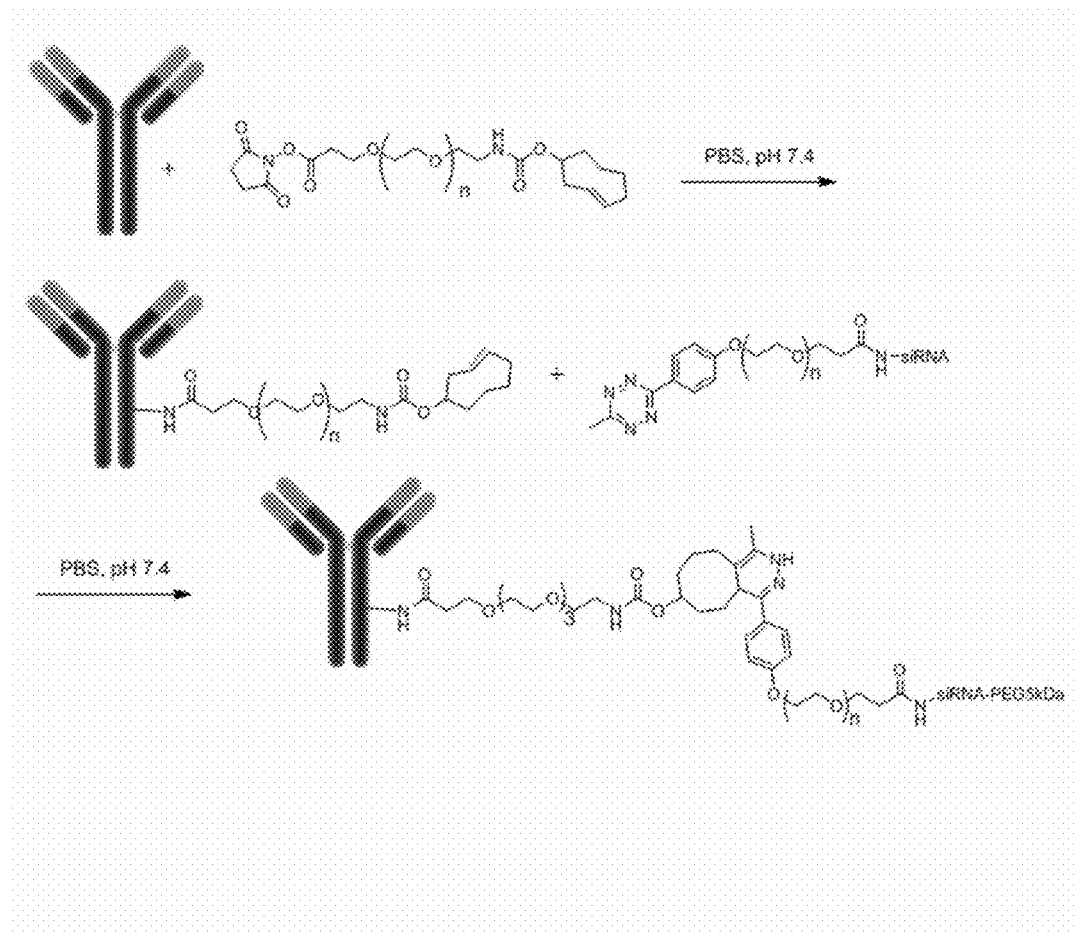
FIG. 101 illustrates Conjugation scheme 14.

Step 1: Antibody Conjugation with NHS-PEG4-TCO Followed by Methyltetraline-PEG4-siRNA-PEG5kDa Antibody was buffer exchanged with pH 7.4 PBS and made up to 5 mg/ml concentration. To this solution, 2 equivalents of NHS-PEG4-TCO linker was added and rotated for 4 hours at room temperature. Unreacted linker was removed by spin filtration using 50 kDa MWCO Amicon spin filters and pH 7.4 PBS. The retentate was collected and 2 equivalents of methyltetraline-PEG4-siRNA-PEG5kDa in pH 7.4 PBS was added at room temperature. The reaction mixture was analyzed by analytical SAX column chromatography and the antibody-siRNA conjugate was seen along with the unreacted antibody and siRNA. See FIG. 101

Step 2: Purification

The crude reaction mixture was purified by AKTA explorer FPLC using anion exchange chromatography method-1. Fractions containing DAR1 and DAR>2 antibody-siRNA conjugates were separated, concentrated and buffer exchanged with pH 7.4 PBS. Typical DAR>2 lysine conjugate contains 70-80% DAR2 and 20-30% DAR3 or higher.

Step-3: Analysis of the Purified Conjugate

The characterization and purity of the isolated conjugate was characterized by either mass spec or SDS-PAGE. The purity of the conjugate was assessed by analytical HPLC using anion exchange chromatography method-2.

Scheme-15: Site Specific Conjugation at Antibody Glycans

Step 1: Antibody Glycan Modification and Gal-$N_3$ Addition

Figure 102:
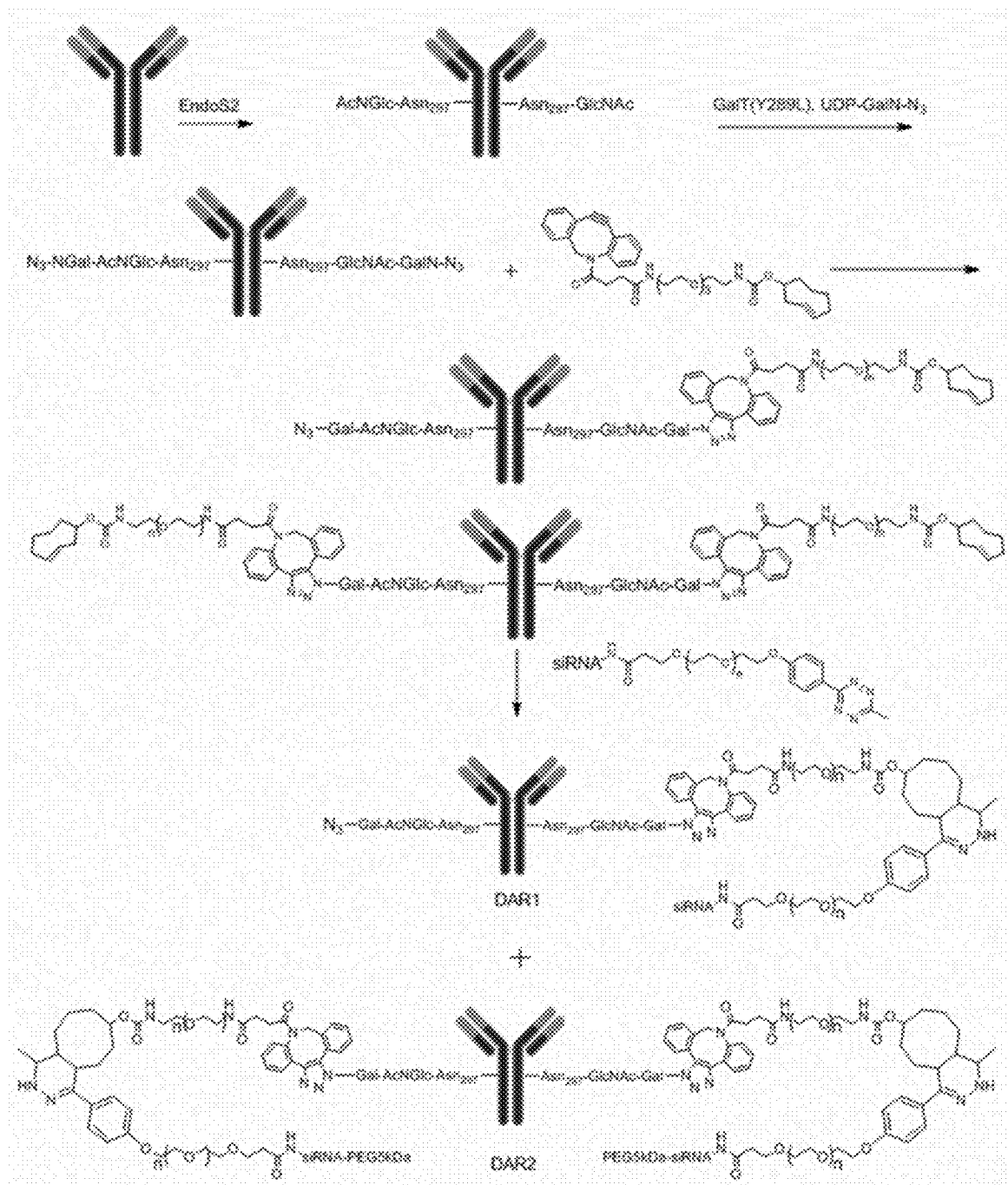
FIG. 102 illustrates Conjugation scheme 15.

Antibody was buffer exchanged with pH 6.0, 50 mM sodium phosphate buffer and treated with EndoS2 at 37° C. for 16 hrs. The reaction mixture was buffer exchanged into TBS buffer (20 mM Tris, 0.9% NaCl, pH 7.4) and UDP-GalNAz was added followed by $MnCl_2$, and Gal-T(Y289L) in 50 mM Tris, 5 mM EDTA (pH 8). The final solution contained concentrations of 0.4 mg/mL antibody, 10 mM $MnCl_2$, 1 mM UDP-GalNAz, and 0.2 mg/mL Gal-T(Y289L) and was incubated overnight at 30° C. See FIG. 102

Step 2: DIBO-PEG-TCO Conjugation to Azide Modified Antibody

The reaction mixture from step-1 was buffer exchanged with PBS and 2 equivalents of DIBO-PEG4-TCO linker was added and rotated for 6 hours at room temperature. Unreacted linker was removed by spin filtration using 50 kDa MWCO Amicon spin filters and pH 7.4 PBS. The retentate was collected and used as is in step-3.

Step 3: Methyl Tetrazine-siRNA Conjugation to TCO Labeled Antibody 2 equivalents of methyltetraline-PEG4-siRNA-PEG5kDa in pH 7.4 PBS was added to the retentate from step-2 and rotated at room temperature for 1 hour. The reaction mixture was analyzed by analytical SAX column chromatography and the antibody-siRNA conjugate was seen along with the unreacted antibody and siRNA.

Step 4: Purification

The crude reaction mixture was purified by AKTA explorer FPLC using anion exchange chromatography method-1. Fractions containing DAR1 and DAR>2 antibody-siRNA conjugates were separated, concentrated and buffer exchanged with pH 7.4 PBS. Typical DAR>2 lysine conjugate contains 70-80% DAR2 and 20-30% DAR3 or higher.

Step-5: Analysis of the Purified Conjugate

The characterization and purity of the isolated conjugate was characterized by either mass spec or SDS-PAGE. The purity of the conjugate was assessed by analytical HPLC using anion exchange chromatography method-2.

Scheme-16: Fab-siRNA Conjugate Generation

Step 1: Antibody Digestion with Pepsin

Figure 103:
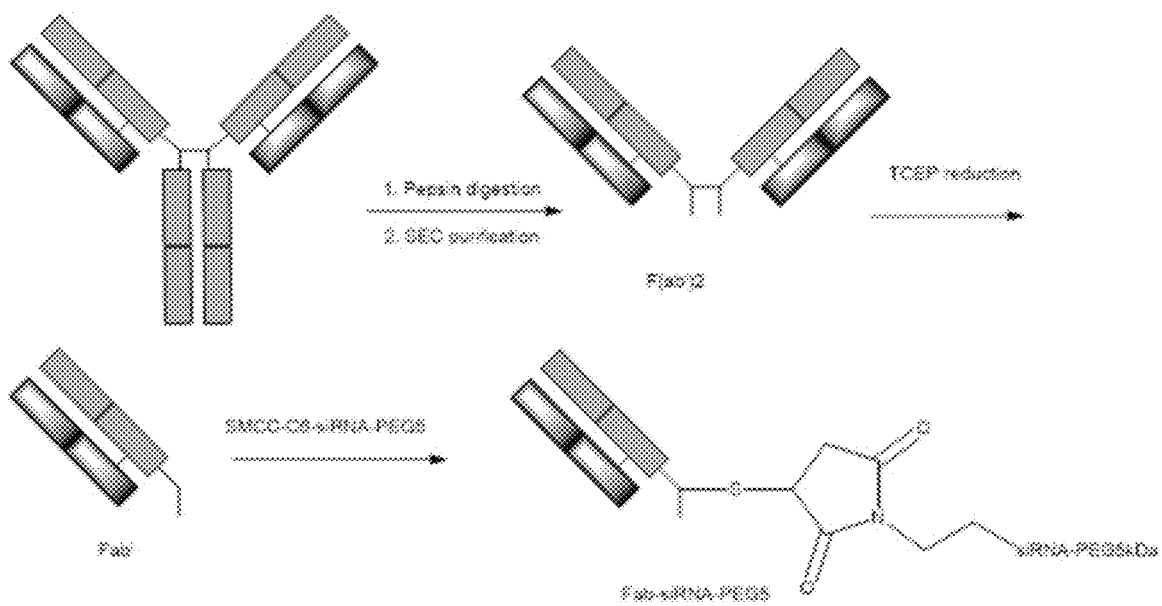
FIG. 103 illustrates Conjugation scheme 16.

Antibody was buffer exchanged with pH 4.0, 20 mM sodium acetate/acetic acid buffer and made up to 5 mg/ml concentration. Immobilized pepsin (Thermo Scientific, Prod#20343) was added and incubated for 3 hours at 37° C. The reaction mixture was filtered using 30 kDa MWCO Amicon spin filters and pH 7.4 PBS. The retentate was collected and purified using size exclusion chromatography to isolate F(ab')2. The collected F(ab')2 was then reduced by 10 equivalents of TCEP and conjugated with SMCC-C6-siRNA-PEG5 at room temperature in pH 7.4 PBS. Analysis of reaction mixture on SAX chromatography showed Fab-siRNA conjugate along with unreacted Fab and siRNA-PEG. See FIG. 103

Step 2: Purification

The crude reaction mixture was purified by AKTA explorer FPLC using anion exchange chromatography method-1. Fractions containing DAR1 and DAR2 Fab-siRNA conjugates were separated, concentrated and buffer exchanged with pH 7.4 PBS.

Step-3: Analysis of the Purified Conjugate

The characterization and purity of the isolated conjugate was assessed by SDS-PAGE and analytical HPLC using anion exchange chromatography method-2.

Purification and Analytical Methods

Anion Exchange Chromatography Method-1.

Column: Tosoh Bioscience, TSKGel SuperQ-SPW, 21.5 mm ID×15 cm, 13 um

Solvent A: 20 mM TRIS buffer, pH 8.0; Solvent B: 20 mM TRIS, 1.5 M NaCl, pH 8.0; Flow Rate: 6.0 ml/min Gradient:

| a. | % A | % B | Column Volume |
|---|---|---|---|
| b. | 100 | 0 | 1.00 |
| c. | 60 | 40 | 18.00 |
| d. | 40 | 60 | 2.00 |
| e. | 40 | 60 | 5.00 |
| f. | 0 | 100 | 2.00 |
| g. | 100 | 0 | 2.00 |

Anion Exchange Chromatography Method-2

Column: Thermo Scientific, ProPac™ SAX-10, Bio LC™, 4×250 mm

Solvent A: 80% 10 mM TRIS pH 8, 20% ethanol; Solvent B: 80% 10 mM TRIS pH 8, 20% ethanol, 1.5 M NaCl; Flow Rate: 1.0 ml/min Gradient:

| a. | Time | % A | % B |
|---|---|---|---|
| b. | 0.0 | 90 | 10 |
| c. | 3.00 | 90 | 10 |
| d. | 11.00 | 40 | 60 |
| e. | 13.00 | 40 | 60 |
| f. | 15.00 | 90 | 10 |
| g. | 20.00 | 90 | 10 |

Anion Exchange Chromatography Method-3

Column: Thermo Scientific, ProPac™ SAX-10, Bio LC™, 4×250 mm

Solvent A: 80% 10 mM TRIS pH 8, 20% ethanol; Solvent B: 80% 10 mM TRIS pH 8, 20% ethanol, 1.5 MNaCl Flow Rate: 0.75 ml/min Gradient:

| a. | Time | % A | % B |
|---|---|---|---|
| b. | 0.0 | 90 | 10 |
| c. | 3.00 | 90 | 10 |
| d. | 11.00 | 40 | 60 |
| e. | 23.00 | 40 | 60 |
| f. | 25.00 | 90 | 10 |
| g. | 30.00 | 90 | 10 |

Size Exclusion Chromatography Method-1

Column: TOSOH Biosciences, TSKgelG3000SW XL, 7.8×300 mm, 5 μM

Mobile phase: 150 mM phosphate buffer

Flow Rate: 1.0 ml/min for 20 mins siRNA Synthesis

All siRNA single strands were fully assembled on solid phase using standard phospharamidite chemistry and purified over HPLC. Purified single strands were duplexed to get the double stranded siRNA.

Each siRNA passenger strand contains two conjugation handles, C6-NH$_2$ and C6-SH, one at each end of the strand. The passenger strand with C6-NH$_2$ handle at 5' end contains C6-SH at its 3' end and the strand that contains C6-NH$_2$ handle at 3' end contains C6-SH at its 5' end. Both conjugation handles are connected to siRNA passenger strand via inverted abasic phosphodiester or phosphorothioate.

Figure 104:
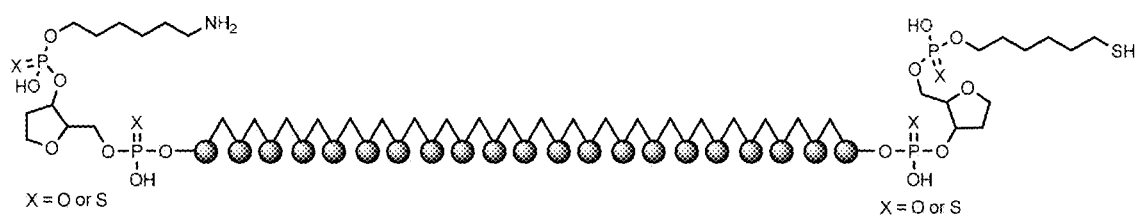
FIG. 104 illustrates a representative structure of siRNA with C6-NH$_2$ conjugation handle at the 5' end and C6-SH at 3'end of the passenger strand.

A representative structure of siRNA with C6-NH$_2$ conjugation handle at the 5' end and C6-SH at 3'end of the passenger strand is shown in FIG. 104.

ASC Architectures Described in Examples 10-41

Figure 105:
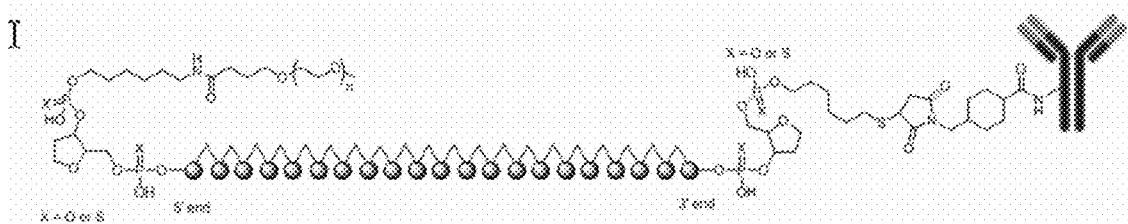
FIG. 105 illustrates Antibody-Lys-SMCC-S-3'-Passenger strand.

ASC Architecture-1: Antibody-Lys-SMCC-S-3'-Passenger strand. This conjugate (see FIG. 105) was generated by antibody lysine-SMCC conjugation to thiol at the 3' end of passenger strand.

Figure 106:
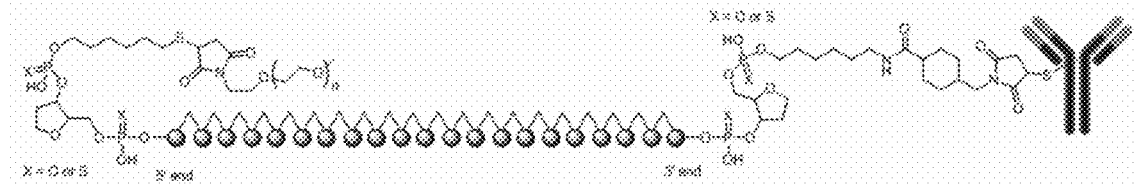
FIG. 106 illustrates Antibody-Cys-SMCC-3'-Passenger strand.

ASC Architecture-2: Antibody-Cys-SMCC-3'-Passenger strand. This conjugate (see FIG. 106) was generated by antibody inter-chain cysteine conjugation to SMCC at the 3' end of passenger strand.

Figure 107:
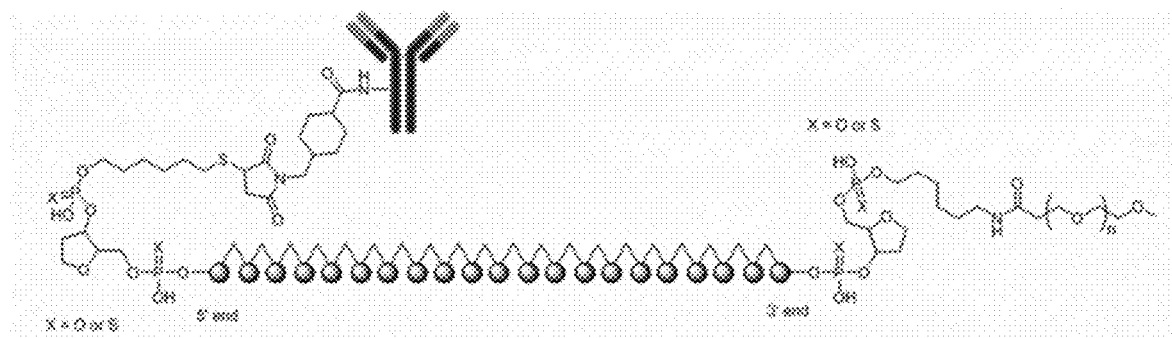
FIG. 107 illustrates Antibody-Lys-SMCC-S-5'-Passenger strand.

ASC Architecture-3: Antibody-Lys-SMCC-S-5'-passenger strand. This conjugate (see FIG. 107) was generated by antibody lysine-SMCC conjugation to C6-thiol at the 5' end of passenger strand.

Figure 108:
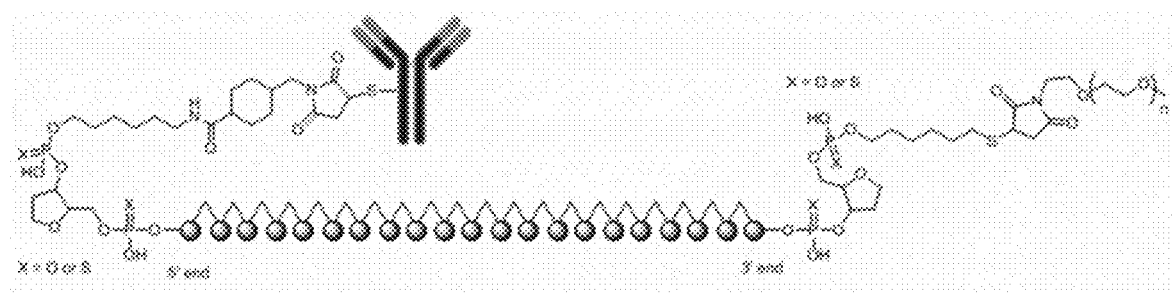
FIG. 108 illustrates Antibody-Cys-SMCC-5'-passenger strand.

ASC Architecture-4: Antibody-Cys-SMCC-5'-passenger strand. This conjugate (see FIG. 108) was generated by antibody inter-chain cysteine conjugation to SMCC at the 5' end of passenger strand.

Figure 109:
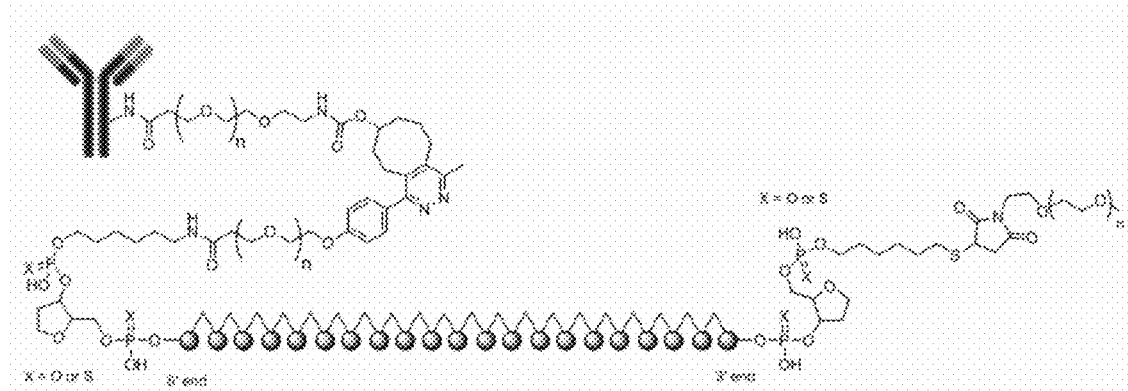
FIG. 109 illustrates Antibody-Lys-PEG-5'-passenger strand.

ASC Architecture-5: Antibody-Lys-PEG-5'-passenger strand. This conjugate (see FIG. 109) was generated by antibody PEG-TCO conjugation to tetrazine at the 5' end of passenger strand.

Figure 110:
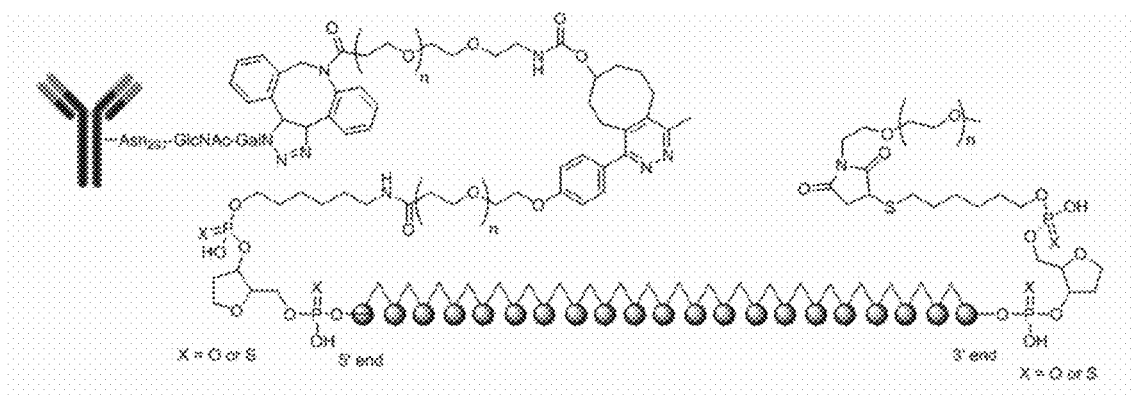
FIG. 110 illustrates Antibody-Lys-PEG-5'-passenger strand.

ASC Architecture-6: Antibody-Lys-PEG-5'-passenger strand. This conjugate (see FIG. 110) was generated by antibody PEG-TCO conjugation to tetrazine at the 5' end of passenger strand.

Figure 111:
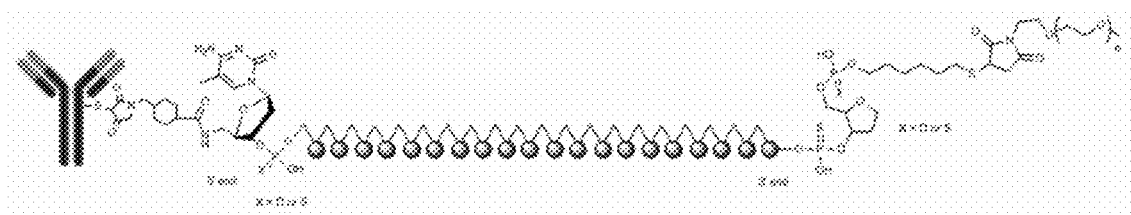
FIG. 111 illustrates Antibody-Cys-PEG-5'-passenger strand without inverted abasic at 5' end.

ASC Architecture-7: Antibody-Cys-PEG-5'-passenger strand without inverted abasic at 5' end. This conjugate (see FIG. 111) was generated using procedure similar to architecture-2. The antibody was conjugated directly to the amine on passenger strand 5' end sugar.

Zalutumumab (EGFR-Ab)

Zalutumumab is a fully human IgG1κ monoclonal antibody directed against the human epidermal growth factor receptor (EGFR). It is produced in the Chinese Hamster Ovary cell line DJT33, which has been derived from the CHO cell line CHO-K1SV by transfection with a GS vector carrying the antibody genes derived from a human anti-EGFR antibody producing hybridoma cell line (2F8). Standard mammalian cell culture and purification technologies are employed in the manufacturing of zalutumumab.

The theoretical molecular weight (MW) of zalutumumab without glycans is 146.6 kDa. The experimental MW of the major glycosylated isoform of the antibody is 149 kDa as determined by mass spectrometry. Using SDS-PAGE under reducing conditions the MW of the light chain was found to be approximately 25 kDa and the MW of the heavy chain to be approximately 50 kDa. The heavy chains are connected to each other by two inter-chain disulfide bonds, and one light chain is attached to each heavy chain by a single inter-chain disulfide bond. The light chain has two intra-chain disulfide bonds and the heavy chain has four intra-chain disulfide bonds. The antibody is N-linked glycosylated at Asn305 of the heavy chain with glycans composed of N-acetyl-glucosamine, mannose, fucose and galactose. The predominant glycans present are fucosylated bi-antennary structures containing zero or one terminal galactose residue. The charged isoform pattern of the IgG1κ antibody has been investigated using imaged capillary IEF, agarose IEF and analytical cation exchange HPLC. Multiple charged isoforms are found, with the main isoform having an isoelectric point of approximately 8.7.

The major mechanism of action of zalutumumab is a concentration dependent inhibition of EGF-induced EGFR phosphorylation in A431 cancer cells. Additionally, induction of antibody-dependent cell-mediated cytotoxicity (ADCC) at low antibody concentrations has been observed in pre-clinical cellular in vitro studies.

Panitumumab (EGFR2-Ab)

Panitumumab is a clinically approved, fully human IgG2 subclass monoclonal antibody specific to the epidermal growth factor receptor (EGFR). Panitumumab has two gamma heavy chains and two kappa light chains. Glycosylated panitumumab has a total molecular weight of approximately 147 kDa. Panitumumab is expressed as a glycoprotein with a single consensus N-linked glycosylation site located on the heavy chain. Panitumumab is produced from Chinese Hamster Ovary (CHO) cells and purified by a series of chromatography steps, viral inactivation step, viral filtration step and ultrafiltration/diafiltration steps.

Panitumumab acts as a competitive antagonist at the ligand binding site of EGFR to inhibit binding and signaling mediated by EGF and transforming growth factor α, the natural ligands for this receptor. The affinity of binding panitumumab to the EGFR was determined be 3.5 and $5.7 \times 10^{-12}$ M in recombinant EGFR using BIAcore methods. Inhibition of binding of EGF was shown in A431 cells, a human epidermal carcinoma cell line that expresses EGFR. Intracellular acidification, phosphorylation and internalization of the EGFR were blocked in a dose-dependent manner by panitumumab in A431 cells. Panitumumab was also shown to inhibit cell growth in vitro and in vivo in the same cell line.

Herceptin (EGFR3-Ab)

Herceptin is a clinically approved, humanized IgG1 subclass monoclonal antibody specific to the epidermal growth factor receptor2 (EGFR2) also known as Her2. Herceptin has human Fc yl isotype along with kappa light chains.

PSMA-Ab

PSMA-Ab is a humanized IgG1 subclass monoclonal antibody specific to prostate specific membrane antigen (PSMA).

ASGR1-Ab

ASGR mAb-Sino103 is a rabbit IgG monoclonal antibody that binds mouse asialoglycoprotein receptor1 (ASGPR1). It is supplied by Sino Biologicals Inc. (Cat #50083-R103).

ASGR2-Ab

ASGR mAb-R&D is a rat $IgG_{2A}$ subclass monoclonal antibody that binds mouse asialoglycoprotein receptor1 (ASGPR1). It is purified by protein A or G from hybridoma culture supernatant and supplied by R&D Systems (Cat # MAB2755)

siRNA-TriGalNAc Conjugate

Figure 112:
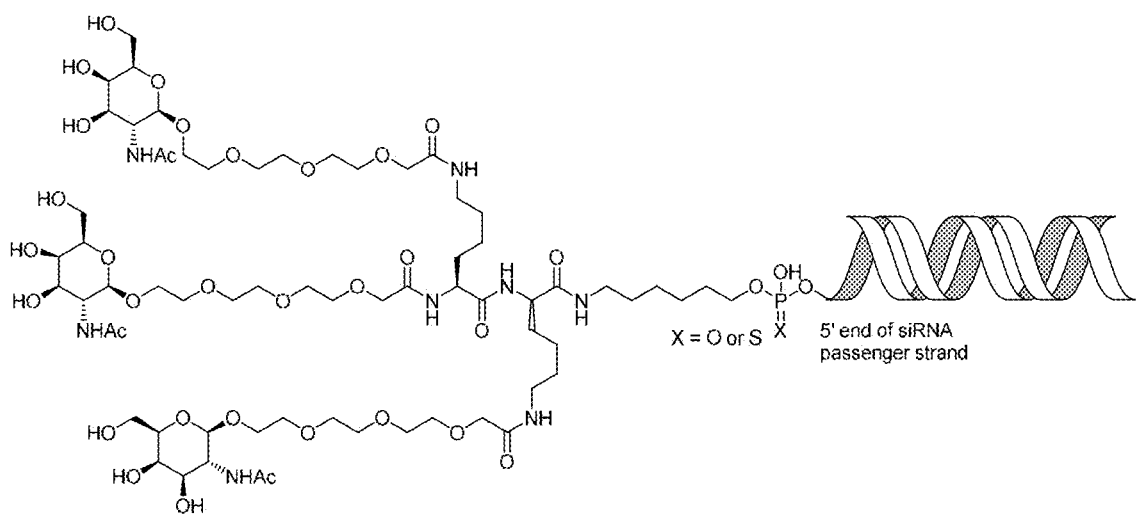
FIG. 112 illustrates an siRNA triGalNAc conjugate.

The siRNA triGalNAc conjugate was synthesized using Lys-Lys dipeptide. Protected triGalNAc was coupled with dipeptide PEG linker and purified. After the removal of carboxylic acid protection group on the triGalNAc-dipeptide was conjugated to the 5' end of siRNA passenger strand. See FIG. 112

Example 10: 2016-PK-163-LNCap siRNA Design and Synthesis

EFGR: A 21mer duplex with 19 bases of complementarity and 3' dinucleotide overhangs was designed against human EGFR. The sequence of the guide/antisense strand was complementary to the gene sequence starting a base position 333 for the human mRNA transcript for EGFR (ACUCGUGCCUUGGCAAACUUU; SEQ ID NO: 2082).

Base, sugar and phosphate modifications were used to optimize the potency of the duplex and reduce immunogenicity. All siRNA single strands were fully assembled on solid phase using standard phospharamidite chemistry and purified over HPLC. Purified single strands were duplexed to obtain the double stranded siRNA. The passenger strand contained two conjugation handles, a C6-NH2 at the 5' end and a C6-SH at the 3' end. Both conjugation handles were connected to siRNA passenger strand via phosphorothioate-inverted abasic-phosphorothioate linker, see Example 9 for the chemical structure.

Negative control siRNA sequence (scramble): A published (Burke et al. (2014) Pharm. Res., 31(12):3445-60) 21mer duplex with 19 bases of complementarity and 3' dinucleotide overhangs was used. The sequence (5' to 3') of the guide/antisense strand was UAUCGACGUGUCCAGC-UAGUU (SEQ ID NO: 2116). Base, sugar and phosphate modifications were used to reduce immunogenicity and were comparable to those used in the active siRNA. All siRNA single strands were fully assembled on solid phase using standard phospharamidite chemistry and purified over HPLC. Purified single strands were duplexed to get the double stranded siRNA. The passenger strand contained two conjugation handles, a C6-NH2 at the 5' end and a C6-SH at the 3' end. Both conjugation handles were connected to siRNA passenger strand via a phosphodiester-inverted abasic-phosphodiester linker, see Example 9 for the chemical structure.

ASC Synthesis and Characterization

The AXBYC conjugate used in groups 3-4 were made and purified as a DAR1 (n=1) using ASC architecture-4, as described in Example 9. The AXB and AXCYB conjugates were made as described in Example 9.

In Vivo Study Design

Groups (n=5) of female SCID SHO mice bearing subcutaneous flank LNCaP tumors 100-350 mm³ in volume were treated with one intravenous (i.v.) tail vein injection of siRNA conjugate, while control groups (n=5) of the same mice received one i.v. injection of PBS as a vehicle control. Treatment groups 1-6 were dosed at 1.0 or 0.5 mg/kg (based on the weight of siRNA) as per the study design below. All groups (treatments and controls) were administered a dose volume of 5 mL/kg. Mice were sacrificed by $CO_2$ asphyxiation at 96 hours post-dose. Table 22 describes the study design in more detail. 50 mg pieces of tumor and liver, were collected and snap-frozen in liquid nitrogen. mRNA knockdown in target tissue was determined using a comparative qPCR assay as described in Example 2. Total RNA was extracted from the tissue, reverse transcribed and mRNA levels were quantified using TaqMan qPCR, using the appropriately designed primers and probes. PPIB (housekeeping gene) was used as an internal RNA loading control, results were calculated by the comparative Ct method, where the difference between the target gene Ct value and the PPIB Ct value (ΔCt) is calculated and then further normalized relative to the PBS control group by taking a second difference (ΔΔCt). Quantitation of tissue siRNA concentrations were determined using a stem-loop qPCR assay as described in Example 2. The antisense strand of the siRNA was reverse transcribed using a TaqMan MicroRNA reverse transcription kit using a sequence-specific stem-loop RT primer. The cDNA from the RT step was then utilized for real-time PCR and Ct values were transformed into plasma or tissue concentrations using the linear equations derived from the standard curves.

TABLE 22

| Group | Test Article | N | siRNA Dose (mg/kg) | ROA | Dose Volume (mL/kg) | # of Doses | Harvest Time (h) |
|---|---|---|---|---|---|---|---|
| 1 | PSMA-Ab(Cys)-EGFR (n = 1) | 5 | 1 | IV | 5.0 | 1 | 96 |
| 2 | PSMA-Ab(Cys)-EGFR (n = 1) | 5 | 0.5 | IV | 5.0 | 1 | 96 |
| 3 | PSMA-Ab(Cys)-EGFR-PEG5k (n = 1) | 5 | 1 | IV | 5.0 | 1 | 96 |
| 4 | PSMA-Ab(Cys)-EGFR-PEG5k (n = 1) | 5 | 0.5 | IV | 5.0 | 1 | 96 |
| 5 | PSMA-Ab(Cys)-PEG5k-EGFR (n = 1) | 5 | 1 | IV | 5.0 | 1 | 96 |
| 6 | PSMA-Ab(Cys)-PEG5k-EGFR (n = 1) | 5 | 0.5 | IV | 5.0 | 1 | 96 |
| 7 | PSMA-Ab(Cys)-scramble-PEG5k (n = 1) | 5 | 1 | IV | 5.0 | 1 | 96 |
| 8 | PBS Control | 5 | — | IV | 5.0 | 1 | 96 |
| | Total # of Animals: | 40 | SCID SHO mice with LNCaP tumors | | | | |

Figure 50A:
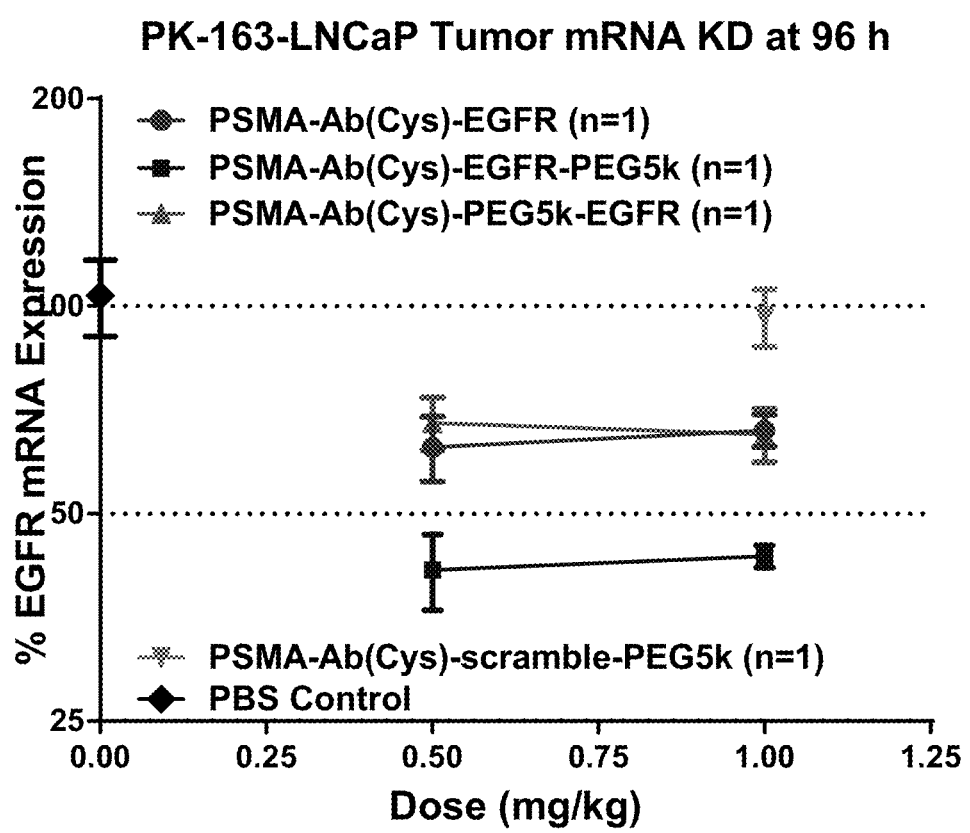
FIG. 50A shows siRNA-mediated mRNA knockdown of human EGFR in LNCaP tumor.

The orientation of the siRNA and PEG relative to the PSMA-Ab was explored in an in vivo mouse tumor model. As illustrated in FIG. 50A, having the siRNA in between the PSMA-Ab and the PEG5k (PSMA-Ab(Cys)-EGFR-PEG5k or the AXBYC format) resulted in higher levels of EGFR mRNA knockdown in the tumor relative to the alternative conjugate where PEG5k is in between the PSMA-Ab and the siRNA (PSMA-Ab(Cys)-PEG5k-EGFR or AXCYB format). This approach (AXBYC) also resulted in higher levels of EGFR mRNA knockdown in the tumor relative to the conjugate without PEG5K (PSMA-Ab(Cys)-EGFR or AXB format).

Figure 50B:
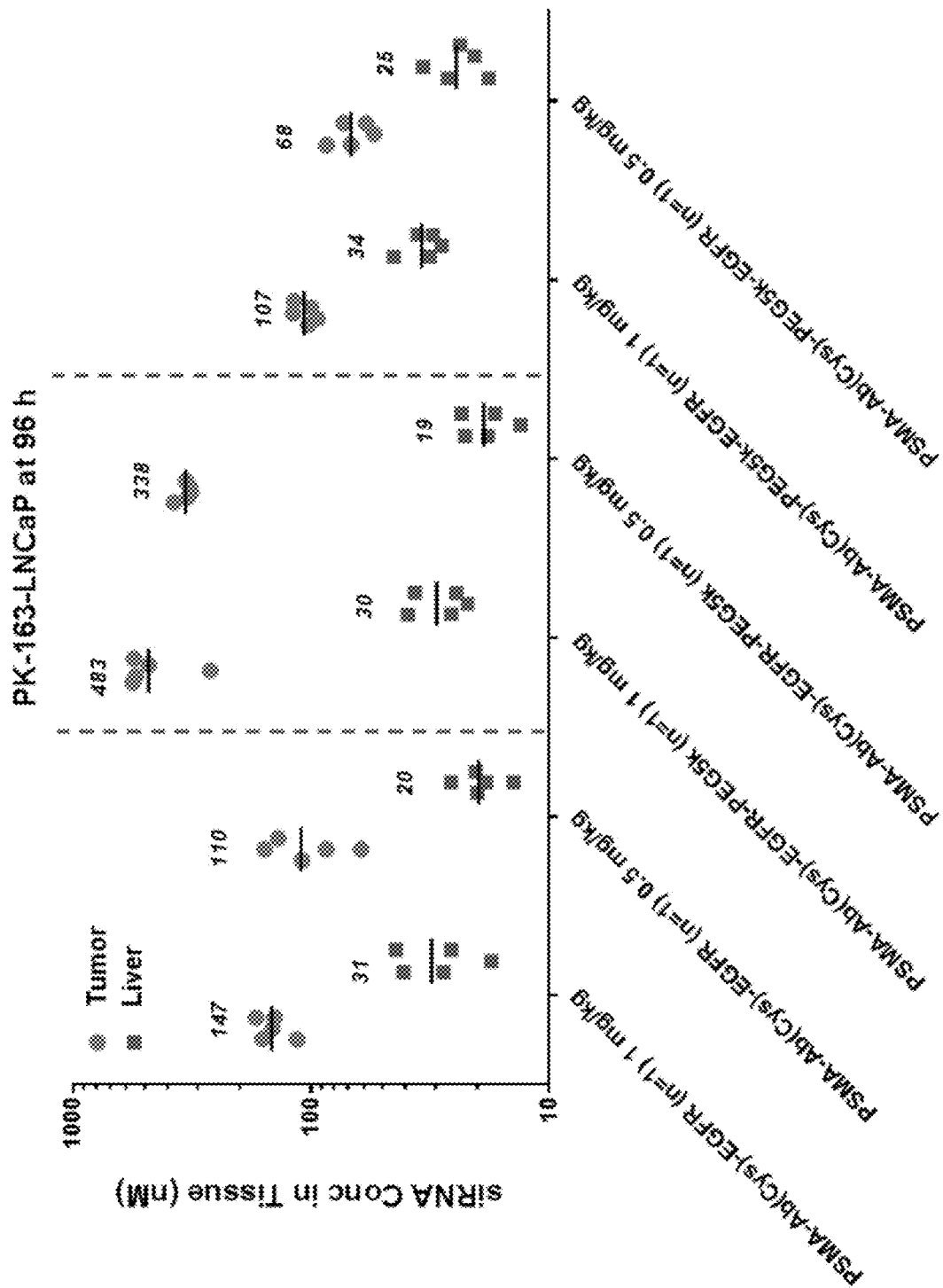
FIG. 50B shows siRNA concentration in tumor or liver tissues at 96 hour post-dose.

The orientation of the siRNA and PEG relative to the PSMA-Ab was also explored relative to the tissue PK profiles. Tissue concentrations were measured pmol/g and then converted to pmol/mL by assuming the density of tissue equals 1 g/mL (a concentration of 1 nM=1 nmol/L=1 pmol/mL=1 pmol/g tissue). As illustrated in FIG. 50B, having the siRNA in between the PSMA-Ab and the PEG5k (AXBYC) resulted in higher levels of siRNA delivery to the tumor relative to the alternative conjugate where PEG5k is in between the PSMA-Ab and the siRNA (AXCYB). This approach (AXBYC) resulted in higher levels of EGFR siRNA delivery to the tumor relative to the conjugate without PEG5K (AXB).

In a mouse LNCaP subcutaneous xenograph model, it was demonstrated that the AXBYC format for the antibody siRNA conjugate resulted in higher levels of siRNA accumulation in the tumor tissue and a greater magnitude of EGFR mRNA knockdown, relative to the AXCYB and AXB formats. The LNCap tumor expresses human PSMA, resulting in tumor tissue specific accumulation of the PSMA targeted siRNA conjugates after i.v. administration, receptor mediate uptake and siRNA facilitated knockdown of the target gene.

Example 11: 2016-PK-202-LNCap siRNA Design and Synthesis

EFGR: A 21mer duplex with 19 bases of complementarity and 3' dinucleotide overhangs was designed against human EGFR. The sequence of the guide/antisense strand was complementary to the gene sequence starting a base position 333 for the human mRNA transcript for EGFR (ACUCGUGCCUUGGCAAACUUU; SEQ ID NO: 2082). Base, sugar and phosphate modifications were used to optimize the potency of the duplex and reduce immunogenicity. All siRNA single strands were fully assembled on solid phase using standard phosphoramidite chemistry and purified over HPLC. Purified single strands were duplexed to get the double stranded siRNA. The passenger strand contained two conjugation handles, a C6-$NH_2$ at the 5' end and a C6-SH at the 3' end. Both conjugation handles were connected to siRNA passenger strand via phosphorothioate-inverted abasic-phosphorothioate linker, see Example 9 for the chemical structure.

Negative control siRNA sequence (scramble): A published (Burke et al. (2014) Pharm. Res., 31(12):3445-60) 21mer duplex with 19 bases of complementarity and 3' dinucleotide overhangs was used. The sequence (5' to 3') of the guide/antisense strand was UAUCGACGUGUCCAGCUAGUU (SEQ ID NO: 2116). Base, sugar and phosphate modifications were used to reduce immunogenicity and were comparable to those used in the active siRNA. All siRNA single strands were fully assembled on solid phase using standard phosphoramidite chemistry and purified over HPLC. Purified single strands were duplexed to get the double stranded siRNA. The passenger strand contained two conjugation handles, a C6-NH2 at the 5' end and a C6-SH at the 3' end. Both conjugation handles were connected to siRNA passenger strand via a phosphodiester-inverted abasic-phosphodiester linker, see Example 9 for the chemical structure.

ASC Synthesis and Characterization

The AXBYC conjugate used in groups 3-5 and 7 was made and purified as a DAR1 (n=1) using ASC architecture-4, as described in Example 9. The AXB (groups 1-2) and AXCYB (group 6) conjugates were made as described in Example 9.

In Vivo Study Design

Groups (n=5) of female SCID SHO mice bearing subcutaneous flank LNCaP tumors 100-350 $mm^3$ in volume were treated with one intravenous (i.v.) tail vein injection of siRNA conjugate, while control groups (n=5) of the same mice received one i.v. injection of PBS as a vehicle control. Treatment groups 1-6 were dosed at 1.0 or 0.5 mg/kg (based on the weight of siRNA) as per the study design below. All groups (treatments and controls) were administered a dose volume of 5 mL/kg. Mice were sacrificed by $CO_2$ asphyxiation at 96 hours post-dose. Table 23 describes the study design in more detail. 50 mg pieces of tumor and liver, were collected and snap-frozen in liquid nitrogen. mRNA knockdown in target tissue was determined using a comparative qPCR assay as described in Example 2. Total RNA was extracted from the tissue, reverse transcribed and mRNA levels were quantified using TaqMan qPCR, using the appropriately designed primers and probes. PPIB (housekeeping gene) was used as an internal RNA loading control, results were calculated by the comparative Ct method, where the difference between the target gene Ct value and the PPIB Ct value (ΔCt) is calculated and then further normalized relative to the PBS control group by taking a second difference (ΔΔCt). Quantitation of tissue siRNA concentrations were determined using a stem-loop qPCR assay as described in Example 2. The antisense strand of the siRNA was reverse transcribed using a TaqMan MicroRNA reverse transcription kit using a sequence-specific stem-loop RT primer. The cDNA from the RT step was then utilized for real-time PCR and Ct values were transformed into plasma or tissue concentrations using the linear equations derived from the standard curves.

TABLE 23

| Group | Test Article | N | siRNA Dose (mg/kg) | ROA | Dose Volume (mL/kg) | # of Doses | Harvest Time (h) |
|---|---|---|---|---|---|---|---|
| 1 | PSMA-Ab(Cys)-EGFR (n = 1) | 5 | 1 | IV | 5.0 | 1 | 96 |
| 2 | PSMA-Ab(Cys)-EGFR (n = 1) | 5 | 0.5 | IV | 5.0 | 1 | 96 |
| 3 | PSMA-Ab(Cys)-EGFR-PEG5k (n = 1) | 5 | 1 | IV | 5.0 | 1 | 96 |
| 4 | PSMA-Ab(Cys)-EGFR-PEG5k (n = 1) | 5 | 0.5 | IV | 5.0 | 1 | 96 |
| 5 | PSMA-Ab(Cys)-EGFR-PEG5k (n = 1) | 5 | 0.25 | IV | 5.0 | 1 | 96 |
| 6 | PSMA-Ab(Cys)-PEG5k-EGFR (n = 1) | 5 | 0.5 | IV | 5.0 | 1 | 96 |
| 7 | PSMA-Ab(Cys)-scramble-PEG5k (n = 1) | 5 | 1 | IV | 5.0 | 1 | 96 |
| 8 | PBS Control | 5 | — | IV | 5.0 | 1 | 96 |
| | Total # of Animals: | 40 | | SCID SHO mice with LNCaP tumors | | | |

Figure 51A:
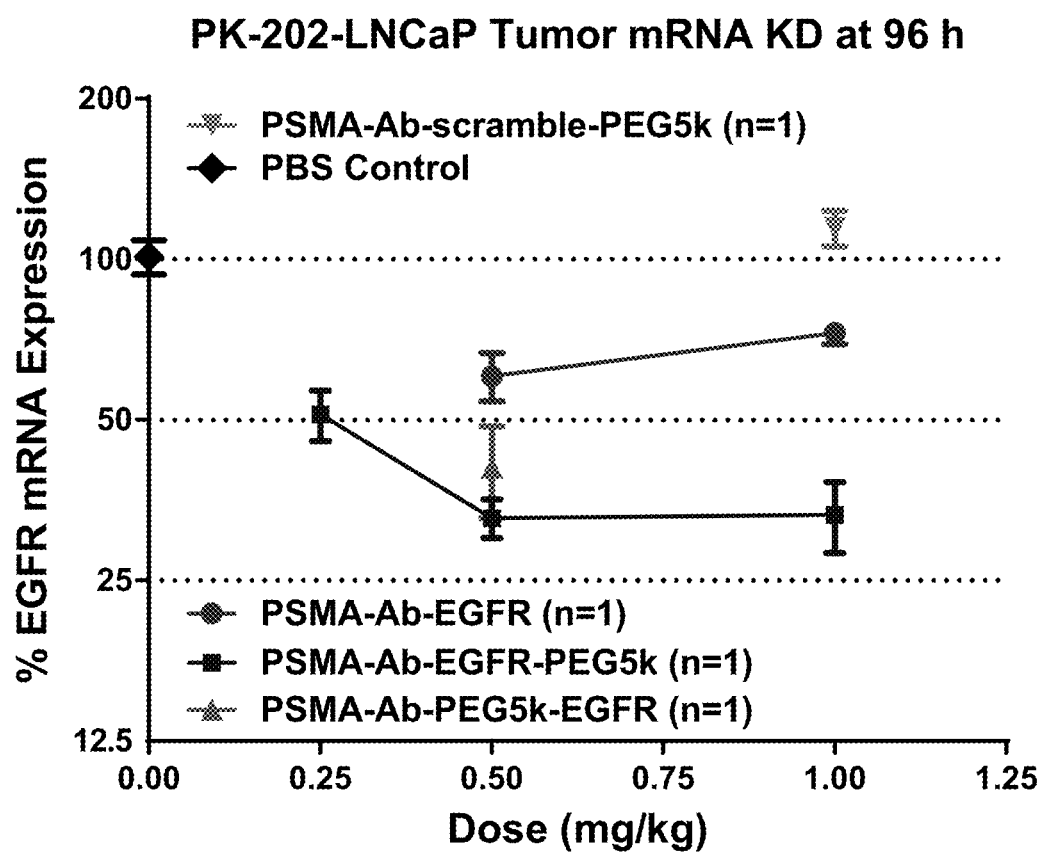
FIG. 51A illustrates siRNA-mediated mRNA knockdown of human EGFR in LNCaP tumor at 96 hour.

The orientation of the siRNA and PEG relative to the PSMA-Ab was also explored in an in vivo mouse tumor model. As illustrated in FIG. 51A, having the siRNA in between the PSMA-Ab and the PEG5k (PSMA-Ab(Cys)-EGFR-PEG5k or AXBYC format)) resulted in higher levels of EGFR mRNA knockdown in the tumor relative to the alternative conjugate where PEG5k is in between the PSMA-Ab and the siRNA (PSMA-Ab(Cys)-PEG5k-EGFR or AXCYB format). This approach (AXBYC) also resulted in higher levels of EGFR mRNA knockdown in the tumor relative to the conjugate without PEG5K (PSMA-Ab(Cys)-EGFR or AXB format).

Figure 51B:
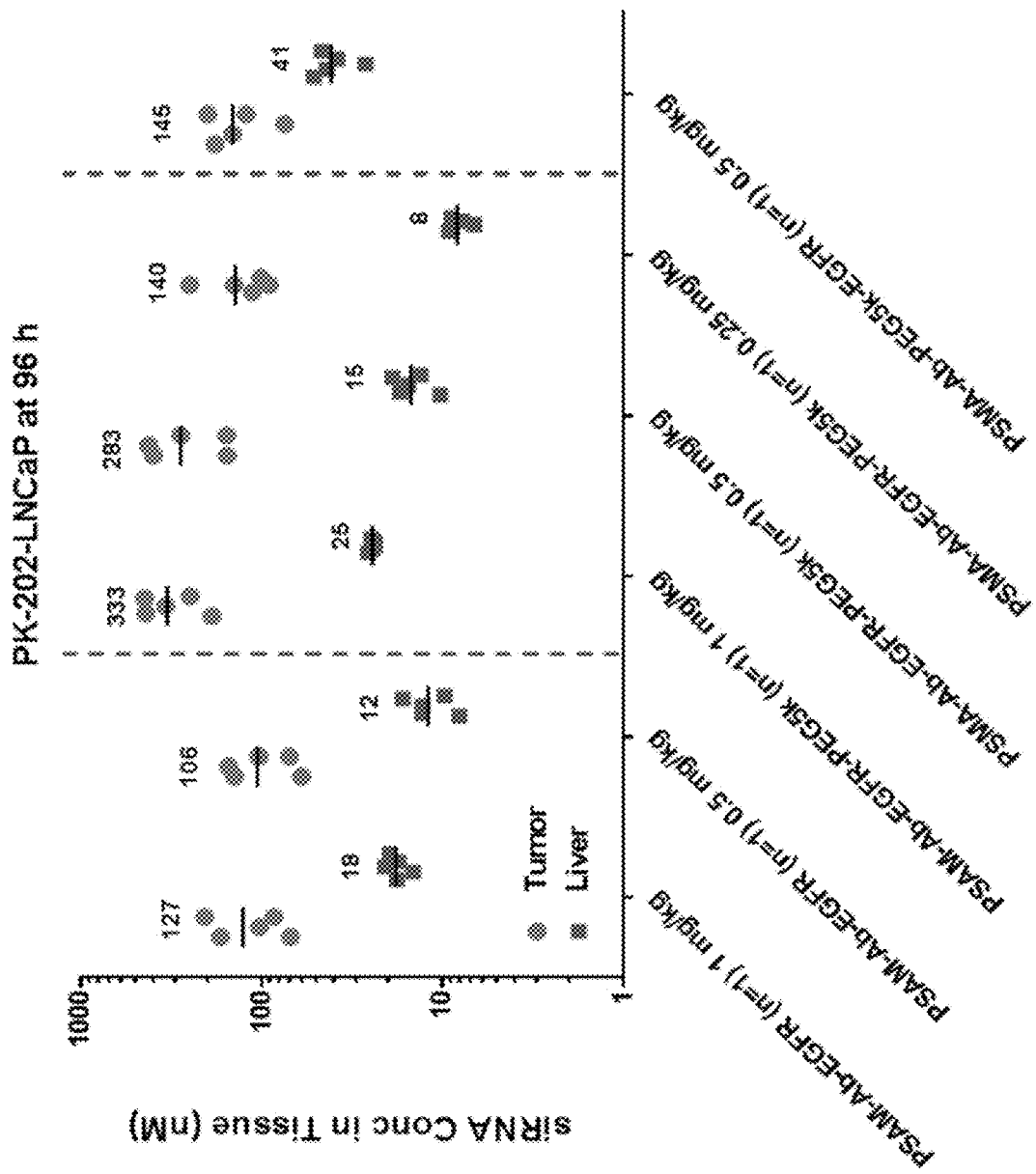
FIG. 51B shows siRNA concentration in tumor or liver tissues at 96 hour post-dose.

The orientation of the siRNA and PEG relative to the PSMA-Ab was also explored relative to the tissue PK profiles. Tissue concentrations were measured pmol/g and then converted to pmol/mL by assuming the density of tissue equals 1 g/mL (a concentration of 1 nM=1 nmol/L=1 pmol/mL=1 pmol/g tissue). As illustrated in FIG. 51B, having the siRNA in between the PSMA-Ab and the PEG5k (PSMA-Ab(Cys)-EGFR-PEG5k or AXBYC format) resulted in higher levels of siRNA delivery to the tumor relative to the alternative conjugate where PEG5k is in between the PSMA-Ab and the siRNA (PSMA-Ab(Cys)-PEG5k-EGFR or AXCYB). This approach (AXBYC) also resulted in higher levels of EGFR siRNA delivery to the tumor relative to the conjugate without PEG5K (PSMA-Ab(Cys)-EGFR or AXB).

In a mouse LNCaP subcutaneous xenograph model, it was demonstrated that the AXBYC format for the antibody siRNA conjugate results in higher levels of siRNA accumulation in the tumor tissue and a greater magnitude of EGFR mRNA knockdown, relative to the AXCYB and AXB formats. The LNCap tumor expresses human PSMA, resulting in tumor tissue specific accumulation of the PSMA targeted siRNA conjugates after i.v. administration, receptor mediate uptake and siRNA facilitated knockdown of the target gene.

Example 12: 2016-PK-219-WT siRNA Design and Synthesis

EFGR: A 21mer duplex with 19 bases of complementarity and 3' dinucleotide overhangs was designed against human EGFR. The sequence of the guide/antisense strand was complementary to the gene sequence starting a base position 333 for the human mRNA transcript for EGFR (ACUCGUGCCUUGGCAAACUUU; SEQ ID NO: 2082)). Base, sugar and phosphate modifications were used to optimize the potency of the duplex and reduce immunogenicity. All siRNA single strands were fully assembled on solid phase using standard phosphoramidite chemistry and purified over HPLC. Purified single strands were duplexed to get the double stranded siRNA. The passenger strand contained two conjugation handles, a C6-NH2 at the 5' end and a C6-SH at the 3' end. Both conjugation handles were connected to siRNA passenger strand via phosphorothioate-inverted abasic-phosphorothioate linker, see Example 9 for the chemical structure.

Negative control siRNA sequence (scramble): A published (Burke et al. (2014) Pharm. Res., 31(12):3445-60) 21mer duplex with 19 bases of complementarity and 3' dinucleotide overhangs was used. The sequence (5' to 3') of the guide/antisense strand was UAUCGACGUGUCCAGC-UAGUU (SEQ ID NO: 2116). Base, sugar and phosphate modifications were used to reduce immunogenicity and were comparable to those used in the active siRNA. All siRNA single strands were fully assembled on solid phase using standard phosphoramidite chemistry and purified over HPLC. Purified single strands were duplexed to get the double stranded siRNA. The passenger strand contained two conjugation handles, a C6-NH2 at the 5' end and a C6-SH at the 3' end. Both conjugation handles were connected to siRNA passenger strand via a phosphodiester-inverted abasic-phosphodiester linker, see Example 9 for the chemical structure.

ASC Synthesis and Characterization

The AXBYC conjugate used in groups 4-6 was made and purified as a DAR1 (n=1) using ASC architecture-4, as described in Example 9. The AXB (groups 1-3) and AXCYB (groups 7-9) and BYC (groups 10-12) conjugates were made as described in Example 9.

In Vivo Study Design

Groups (n=4) of wild-type female CD-1 mice were treated with one intravenous (i.v.) tail vein injections of siRNA conjugates. Treatment groups received 0.5 mg/kg (based on the weight of siRNA) and all groups were administered a dose volume of 5.0 mL/kg. Table 24 illustrates the study design in more detail. Non-terminal blood samples were collected at 5, 30, and 180 minutes post-dose via puncture of the retro-orbital plexus and centrifuged to generate plasma for PK analysis. Mice were sacrificed by $CO_2$ asphyxiation at 24, 96, or 168 h post-dose. Terminal blood samples were collected via cardiac puncture and processed to generate plasma for PK analysis. Quantitation of plasma siRNA concentrations were determined using a stem-loop qPCR assay as described in Example 2. The antisense strand of the siRNA was reverse transcribed using a TaqMan MicroRNA reverse transcription kit using a sequence-specific stem-loop RT primer. The cDNA from the RT step was then utilized for real-time PCR and Ct values were transformed into plasma or tissue concentrations using the linear equations derived from the standard curves.

siRNA duplex were used in the negative control siRNA. All siRNA single strands were fully assembled on solid phase using standard phosphoramidite chemistry and purified over HPLC. Purified single strands were duplexed to get the double stranded siRNA.

ASC Synthesis and Characterization

All conjugates were made and purified as a DAR1 (n=1) using ASC architecture-4, as described in Example 9.

TABLE 24

| Group | Test Article | N | siRNA Dose (mg/kg) | ROA | # of Doses | Dose Schedule | Survival Bleed (min) | Terminal Bleed (h) |
|---|---|---|---|---|---|---|---|---|
| 1 | EGFR-Ab(Cys)-EGFR | 4 | 0.5 | IV | 1 | t = 0 | 5 | 24 |
| 2 | (n = 1) | 4 | 0.5 | IV | 1 | t = 0 | 30 | 96 |
| 3 |  | 4 | 0.5 | IV | 1 | t = 0 | 180 | 168 |
| 4 | EGFR-Ab(Cys)-EGFR- | 4 | 0.5 | IV | 1 | t = 0 | 5 | 24 |
| 5 | PEG5k (n = 1) | 4 | 0.5 | IV | 1 | t = 0 | 30 | 96 |
| 6 |  | 4 | 0.5 | IV | 1 | t = 0 | 180 | 168 |
| 7 | EGFR-Ab(Cys)-PEG5k- | 4 | 0.5 | IV | 1 | t = 0 | 5 | 24 |
| 8 | EGFR (n = 1) | 4 | 0.5 | IV | 1 | t = 0 | 30 | 96 |
| 9 |  | 4 | 0.5 | IV | 1 | t = 0 | 180 | 168 |
| 10 | EGFR Alone (aka | 4 | 0.5 | IV | 1 | t = 0 | 5 | 24 |
| 11 | EGFR-PEG5k) | 4 | 0.5 | IV | 1 | t = 0 | 30 | 96 |
| 12 |  | 4 | 0.5 | IV | 1 | t = 0 | 180 | 168 |
|  | Total # of Animals: | 48 |  |  | WT mice CD-1 |  |  |  |

Figure 52:
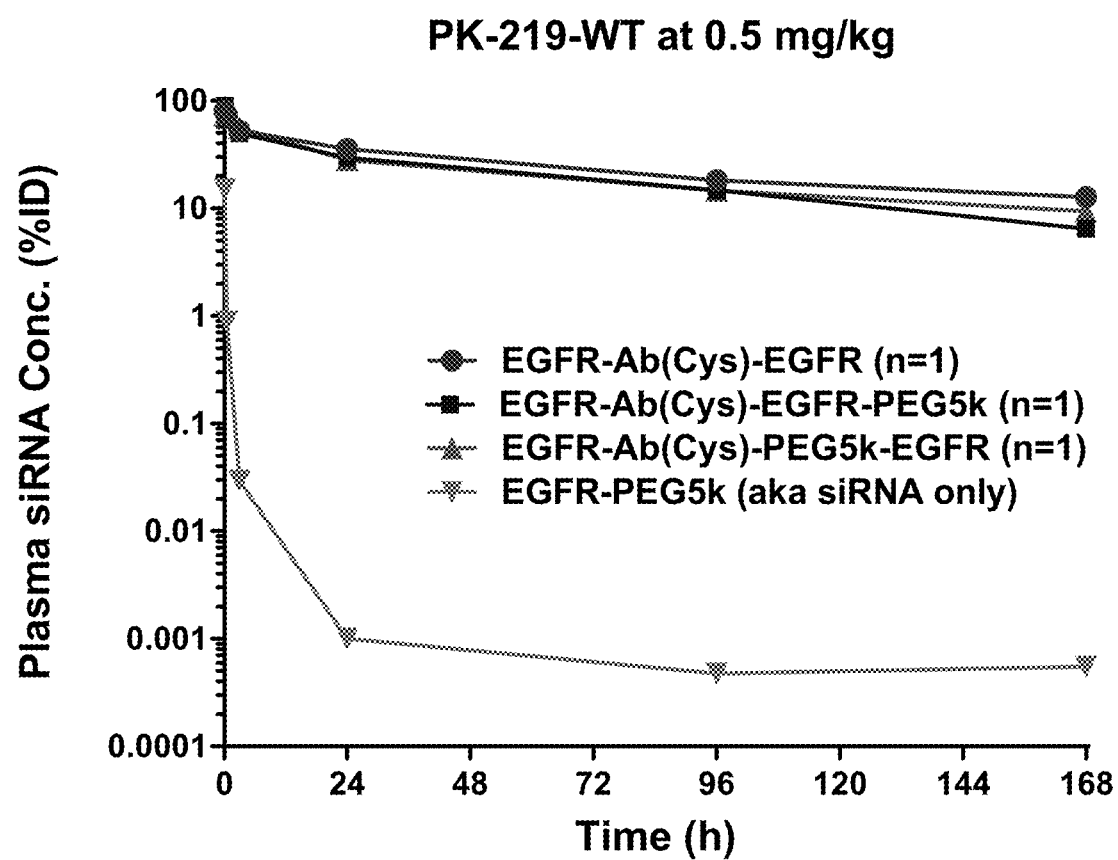
FIG. 52 shows plasma siRNA concentration of exemplary molecules described herein.

In this in vivo PK experiment the orientation of the siRNA and PEG relative to the EGFR-Ab was explored to determine the behavior of the mAb-siRNA conjugate in plasma. As illustrated in FIG. 52, all the mAb-siRNA conjugates (AXB, AXBYC and AXCYB formats) had comparable plasma PK with approximately 10% of the siRNA remaining in the systemic circulation after 168 hours (7 days), compared to the siRNA-PEG5K (BYC format) which was rapidly cleared from the plasma.

The AXBYC format for the antibody siRNA conjugate has improved PK properties relative the siRNA-PEG conjugate (BYC) which was rapidly cleared from the plasma.

Example 13: 2016-PK-199-HCC827 siRNA Design and Synthesis

EFGR: A 21mer duplex with 19 bases of complementarity and 3' dinucleotide overhangs was designed against human EGFR. The sequence of the guide/antisense strand was complementary to the gene sequence starting a base position 333 for the human mRNA transcript for EGFR (ACUCGUGCCUUGGCAAACUUU; SEQ ID NO: 2082)). Base, sugar and phosphate modifications were used to optimize the potency of the duplex and reduce immunogenicity. All siRNA single strands were fully assembled on solid phase using standard phosphoramidite chemistry and purified over HPLC. Purified single strands were duplexed to get the double stranded siRNA.

Negative control siRNA sequence (scramble): A published (Burke et al. (2014) Pharm. Res., 31(12):3445-60) 21mer duplex with 19 bases of complementarity and 3' dinucleotide overhangs was used. The sequence (5' to 3') of the guide/antisense strand was UAUCGACGUGUCCAGC-UAGUU (SEQ ID NO: 2116). The same base, sugar and phosphate modifications that were used for the active EGFR In Vivo Study Design Groups (n=5) of female NCr nu/nu mice bearing subcutaneously (SC) flank HCC827 tumors 100-300 mm$^3$ in volume were treated with one intravenous (i.v.) tail vein injection of siRNA conjugate, while control groups (n=5) of the same mice received one i.v. injection of PBS as a vehicle control. Treatment groups 1-3 and 4-6 were dosed at 1.0, 0.5 or 0.25 mg/kg (based on the weight of siRNA) as per the study design below. As described in Example 9, groups 1-3 contained the same targeting antibody, but groups 4-6 had a different EGFR targeting antibody, while the rest of the conjugate components (linker, siRNA and PEG) were identical. Group 7 received an antibody conjugate with a negative control siRNA sequence (scramble) as a control for groups 1. All groups (treatments and controls) were administered a dose volume of 5 mL/kg. Mice were sacrificed by $CO_2$ asphyxiation at 96 hours post-dose. Table 25 describes the study design in more detail. 50 mg pieces of tumor and liver, were collected and snap-frozen in liquid nitrogen. mRNA knockdown in target tissue was determined using a comparative qPCR assay as described in Example 2. Total RNA was extracted from the tissue, reverse transcribed and mRNA levels were quantified using TaqMan qPCR, using the appropriately designed primers and probes. PPIB (housekeeping gene) was used as an internal RNA loading control, results were calculated by the comparative Ct method, where the difference between the target gene Ct value and the PPIB Ct value (ΔCt) is calculated and then further normalized relative to the PBS control group by taking a second difference (ΔΔCt). Quantitation of tissue siRNA concentrations were determined using a stem-loop qPCR assay as described in Example 2. The antisense strand of the siRNA was reverse transcribed using a TaqMan MicroRNA reverse transcription kit using a sequence-specific stem-loop RT primer. The cDNA from the RT step was then utilized for real-time PCR and Ct values were transformed into plasma or tissue concentrations using the linear equations derived from the standard curves.

TABLE 25

Figure 53A:
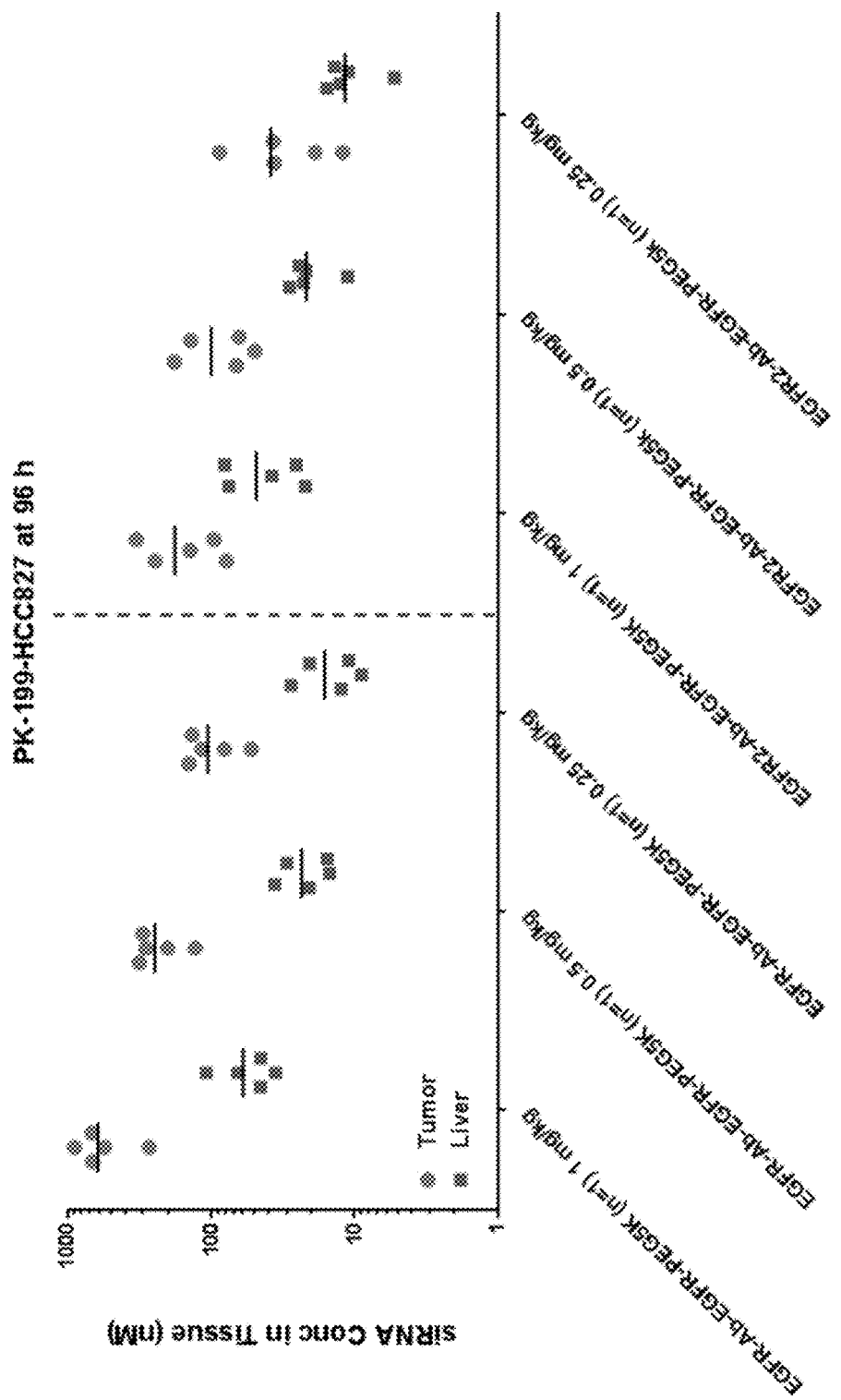
FIG. 53A illustrates siRNA concentration of exemplary molecules described herein in HCC827 tumor or liver tissue.
Figure 53B:
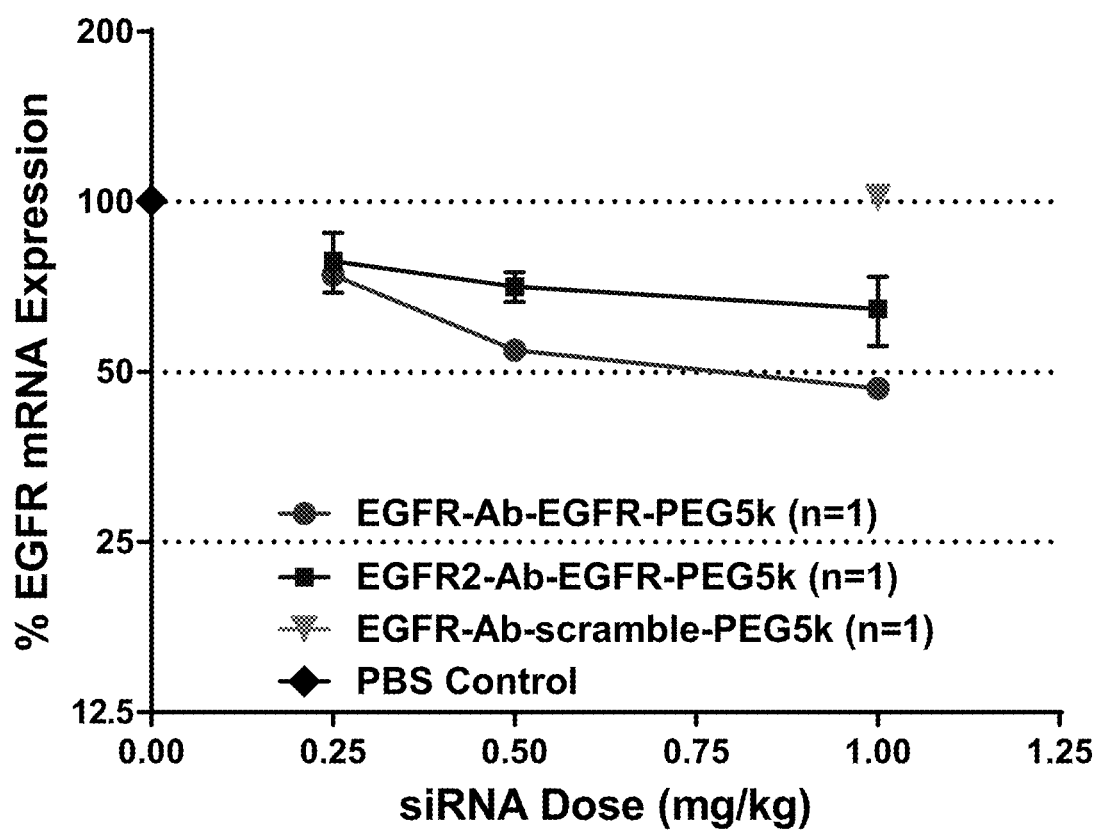
FIG. 53B shows EGFR EGFR mRNA expression level of exemplary molecules described herein.

| Group | Test Article | N | siRNA Dose (mg/kg) | ROA | Dose Volume (mL/kg) | # of Doses | Harvest Time (h) |
|---|---|---|---|---|---|---|---|
| 1 | EGFR-Ab(Cys)-EGFR-PEG5k (n = 1) | 5 | 1 | IV | 5.0 | 1 | 96 |
| 2 | EGFR-Ab(Cys)-EGFR-PEG5k (n = 1) | 5 | 0.5 | IV | 5.0 | 1 | 96 |
| 3 | EGFR-Ab(Cys)-EGFR-PEG5k (n = 1) | 5 | 0.25 | IV | 5.0 | 1 | 96 |
| 4 | EGFR2-Ab(Cys)-EGFR-PEG5k (n = 1) | 5 | 1 | IV | 5.0 | 1 | 96 |
| 5 | EGFR2-Ab(Cys)-EGFR-PEG5k (n = 1) | 5 | 0.5 | IV | 5.0 | 1 | 96 |
| 6 | EGFR2-Ab(Cys)-EGFR-PEG5k (n = 1) | 5 | 0.25 | IV | 5.0 | 1 | 96 |
| 7 | EGFR-Ab(Cys)-scramble-PEG5k (n = 1) | 5 | 1 | IV | 5.0 | 1 | 96 |
| 8 | PBS Control | 5 | — | IV | 5.0 | 1 | 96 |
| | Total # of Animals: | 40 | nu/nu mice with HCC827 tumors | | | | | siRNA concentrations were determined 96 hours in the tumor and liver after a single i.v. injection at 1.0, 0.5 and 0.25 mg/kg. Tissue concentrations were measured pmol/g and then converted to pmol/mL by assuming the density of tissue equals 1 g/mL. In FIG. 53A, a concentration of 1 nM=1 nmol/L=1 pmol/mL=1 pmol/g tissue. As illustrated in FIG. 53A, both antibody conjugates were capable of delivering higher levels of siRNA to the tumor relative to the liver, and a dose response was observed. The EGFR antibody conjugate was capable of delivering more siRNA to the tumor tissue, at all the doses tested, relative to the EGFR2 antibody. See FIG. 53B. Both conjugates were capable of EGFR gene specific mRNA knockdown at 96 hours post-administration. The control conjugate that contained the scrambled siRNA and the PBS vehicle control did not produce significant EGFR gene specific mRNA knockdown.

As highlighted in FIG. 54, biological activity was demonstrated with the A-X-B—Y-C conjugate with a range of different antibodies and siRNA cargos that are capable of in vivo biological activity in a range of different tissue targets. In this example, it was demonstrated that tumor specific accumulation of 2 conjugates targeted with two different EGFR antibodies conjugated to an siRNA designed to down regulate EGFR mRNA. The HCC827 tumor expresses high levels of human EGFR and both conjugates have a human specific EGFR antibody to target the siRNA, resulting in tumor tissue specific accumulation of the conjugates. Receptor mediate uptake resulted in siRNA mediated knockdown of the target gene.

Example 14: 2016-PK-236-HCC827 siRNA Design and Synthesis

EFGR: A 21mer duplex with 19 bases of complementarity and 3' dinucleotide overhangs was designed against human EGFR. The sequence of the guide/antisense strand was complementary to the gene sequence starting a base position 333 for the human mRNA transcript for EGFR (ACUCGUGCCUUGGCAAACUUU; SEQ ID NO: 2082). Base, sugar and phosphate modifications were used to optimize the potency of the duplex and reduce immunogenicity. All siRNA single strands were fully assembled on solid phase using standard phospharamidite chemistry and purified over HPLC. Purified single strands were duplexed to get the double stranded siRNA. The passenger strand contained two conjugation handles, a C6-NH2 at the 5' end and a C6-SH at the 3' end. Both conjugation handles were connected to siRNA passenger strand via phosphorothioate-inverted abasic-phosphorothioate linker, see Example 9 for the chemical structure.

Negative control siRNA sequence (scramble): A published (Burke et al. (2014) Pharm. Res., 31(12):3445-60) 21mer duplex with 19 bases of complementarity and 3' dinucleotide overhangs was used. The sequence (5' to 3') of the guide/antisense strand was UAUCGACGUGUCCAGC-UAGUU (SEQ ID NO: 2116). Base, sugar and phosphate modifications were used to reduce immunogenicity and were comparable to those used in the active siRNA. All siRNA single strands were fully assembled on solid phase using standard phospharamidite chemistry and purified over HPLC. Purified single strands were duplexed to get the double stranded siRNA. The passenger strand contained two conjugation handles, a C6-NH$_2$ at the 5' end and a C6-SH at the 3' end. Both conjugation handles were connected to siRNA passenger strand via a phosphodiester-inverted abasic-phosphodiester linker, see Example 9 for the chemical structure.

ASC Synthesis and Characterization

All conjugates were made and purified as a DAR1 (n=1) using ASC architecture-4, as described in Example 9.

In Vivo Study Design

Groups (n=5) of female NCr nu/nu mice bearing subcutaneously (SC) flank HCC827 tumors 100-300 mm$^3$ in volume were treated with one intravenous (i.v.) tail vein injection of siRNA conjugate, while control group 6 (n=5) of the same mice received one i.v. injection of PBS as a vehicle control. Treatment groups 1-3 were dosed at 1.0, 0.5 or 0.25 mg/kg (based on the weight of siRNA), groups 4 and 5 at 1.0 mg/kg, as per the study design below. As described in Example 9, groups 1-3 contained the same targeting antibody, but groups 4 had a different EGFR targeting antibody, while the rest of the conjugate components (linker, siRNA and PEG) were identical. Group 6 received an antibody conjugate with a negative control siRNA sequence (scramble) as a control for groups 5. All groups (treatments and controls) were administered a dose volume of 5 mL/kg. Mice were sacrificed by CO$_2$ asphyxiation at 96 hours post-dose. Table 26 describes the study design in more detail. 50 mg pieces of tumor and liver, were collected and snap-frozen in liquid nitrogen. mRNA knockdown in target tissue was determined using a comparative qPCR assay as described in Example 2. Total RNA was extracted from the tissue, reverse transcribed and mRNA levels were quantified using TaqMan qPCR, using the appropriately designed primers and probes. PPIB (housekeeping gene) was used as an internal RNA loading control, results were calculated by the comparative Ct method, where the difference between the target gene Ct value and the PPIB Ct value (ΔCt) is calculated and then further normalized relative to the PBS control group by taking a second difference (ΔΔCt).

TABLE 26

| Group | Test Article | N | siRNA Dose (mg/kg) | ROA | Dose Volume (mL/kg) | # of Doses | Harvest Time (h) |
|---|---|---|---|---|---|---|---|
| 1 | EGFR3-Ab(Cys)-EGFR-PEG5k (n = 1) | 5 | 1 | IV | 5.0 | 1 | 96 |
| 2 | EGFR3-Ab(Cys)-EGFR-PEG5k (n = 1) | 5 | 0.5 | IV | 5.0 | 1 | 96 |
| 3 | EGFR3-Ab(Cys)-EGFR-PEG5k (n = 1) | 5 | 0.25 | IV | 5.0 | 1 | 96 |
| 4 | EGFR-Ab(Cys)-EGFR-PEG5k (n = 1) | 5 | 1 | IV | 5.0 | 1 | 96 |
| 5 | EGFR-Ab(Cys)-scramble-PEG5k (n = 1) | 5 | 1 | IV | 5.0 | 1 | 96 |
| 6 | PBS Control | 5 | — | IV | 5.0 | 1 | 96 |
| | Total # of Animals: | 30 | nu/nu mice with HCC827 tumors | | | | |

Figure 55:
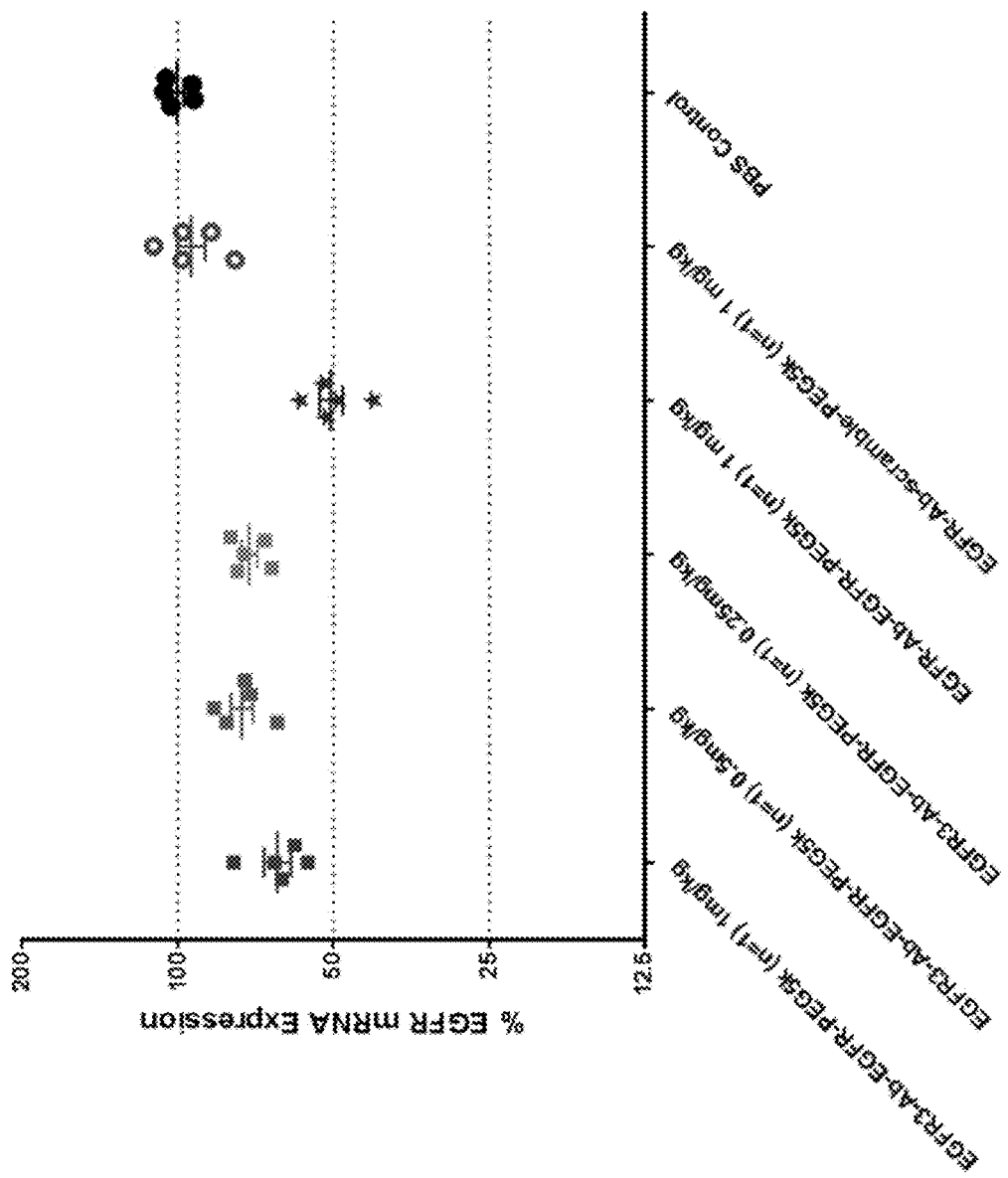
FIG. 55 illustrates EGFR mRNA expression level of exemplary molecules described herein.

In this in vivo PD experiment, it was demonstrated that dose dependent EGFR gene specific mRNA knockdown (FIG. 55) at 96 hour's post-administration with a third example of an EGFR antibody targeting agent (EGFR3). The control conjugate that contained the scrambled siRNA and the PBS vehicle control did not produce significant EGFR gene specific mRNA knockdown.

As highlighted in FIG. 54, it was demonstrated that biological activity with the A-X-B—Y-C conjugate with a range of different antibodies and siRNA cargos that are capable of in vivo biological activity in a range of different tissue targets. In this example, it was demonstrated that tumor specific down regulation of EGFR mRNA using a third EGFR antibody targeting ligand. The HCC827 tumor expresses human EGFR and both conjugates have a human specific EGFR antibody (EGFR and EGFR3) to target the siRNA, resulting in tumor tissue specific accumulation of the conjugates. Receptor mediate uptake resulted in siRNA mediated knockdown of the target gene.

Example 15: 2016-PK-234-HCC827 siRNA Design and Synthesis

EFGR: A 21mer duplex with 19 bases of complementarity and 3' dinucleotide overhangs was designed against human EGFR. The sequence (5' to 3') of the guide/antisense strand was TCUCGUGCCUUGGCAAACUUU (SEQ ID NO: 2117) and it was design to be complementary to the gene sequence starting a base position 333 for the human mRNA transcript for EGFR. Base, sugar and phosphate modifications were used to optimize the potency of the duplex and reduce immunogenicity. All siRNA single strands were fully assembled on solid phase using standard phosphoramidite chemistry and purified over HPLC. Purified single strands were duplexed to get the double stranded siRNA. The passenger strand contained two conjugation handles, a C6-NH2 at the 5' end and a C6-SH at the 3' end. Both conjugation handles were connected to siRNA passenger strand via phosphorothioate-inverted abasic-phosphorothioate linker, see Example 9 for the chemical structure.

Negative control siRNA sequence (scramble): A published (Burke et al. (2014) Pharm. Res., 31(12):3445-60) 21mer duplex with 19 bases of complementarity and 3' dinucleotide overhangs was used. The sequence (5' to 3') of the guide/antisense strand was UAUCGACGUGUCCAGCUAGUU (SEQ ID NO: 2116). Base, sugar and phosphate modifications were used to reduce immunogenicity and were comparable to those used in the active siRNA. All siRNA single strands were fully assembled on solid phase using standard phosphoramidite chemistry and purified over HPLC. Purified single strands were duplexed to get the double stranded siRNA. The passenger strand contained two conjugation handles, a C6-NH2 at the 5' end and a C6-SH at the 3' end. Both conjugation handles were connected to siRNA passenger strand via a phosphodiester-inverted abasic-phosphodiester linker, see Example 9 for the chemical structure.

ASC Synthesis and Characterization

All conjugates were made and purified as a DAR1 (n=1) using ASC architecture-4, as described in Example 9.

In Vivo Study Design

Groups (n=5) of female NCr nu/nu mice bearing subcutaneously (SC) flank HCC827 tumors 100-300 mm$^3$ in volume were treated with one intravenous (i.v.) tail vein injection of siRNA conjugate, while control group 10 (n=5) of the same mice received one i.v. injection of PBS as a vehicle control. Treatment groups 1-3, 4-6 and 7-9 were dosed at 1.0, 0.5 or 0.25 mg/kg (based on the weight of siRNA), as per the study design below. As described in Example 9, groups 1-3 contained the same targeting antibody (EGFR3) but groups 4-9 had a different EGFR targeting antibody, while the rest of the conjugate components (linker, siRNA and PEG) were identical. Group 7-9 received an antibody conjugate with a negative control siRNA sequence (scramble) as a control for groups 1-6. All groups (treatments and controls) were administered a dose volume of 5 mL/kg. Mice were sacrificed by $CO_2$ asphyxiation at 96 hours post-dose. Table 27 describes the study design in more detail. 50 mg pieces of tumor and liver, were collected and snap-frozen in liquid nitrogen. mRNA knockdown in target tissue was determined using a comparative qPCR assay as described in Example 2. Total RNA was extracted from the tissue, reverse transcribed and mRNA levels were quantified using TaqMan qPCR, using the appropriately designed primers and probes. PPIB (housekeeping gene) was used as an internal RNA loading control, results were calculated by the comparative Ct method, where the difference between the target gene Ct value and the PPIB Ct value (ΔCt) is calculated and then further normalized relative to the PBS control group by taking a second difference (ΔΔCt). Quantitation of tissue siRNA concentrations were determined using a stem-loop qPCR assay as described in Example 2. The antisense strand of the siRNA was reverse transcribed using a TaqMan MicroRNA reverse transcription kit using a sequence-specific stem-loop RT primer. The cDNA from the RT step was then utilized for real-time PCR and Ct values were transformed into plasma or tissue concentrations using the linear equations derived from the standard curves.

TABLE 27

Figure 56A:
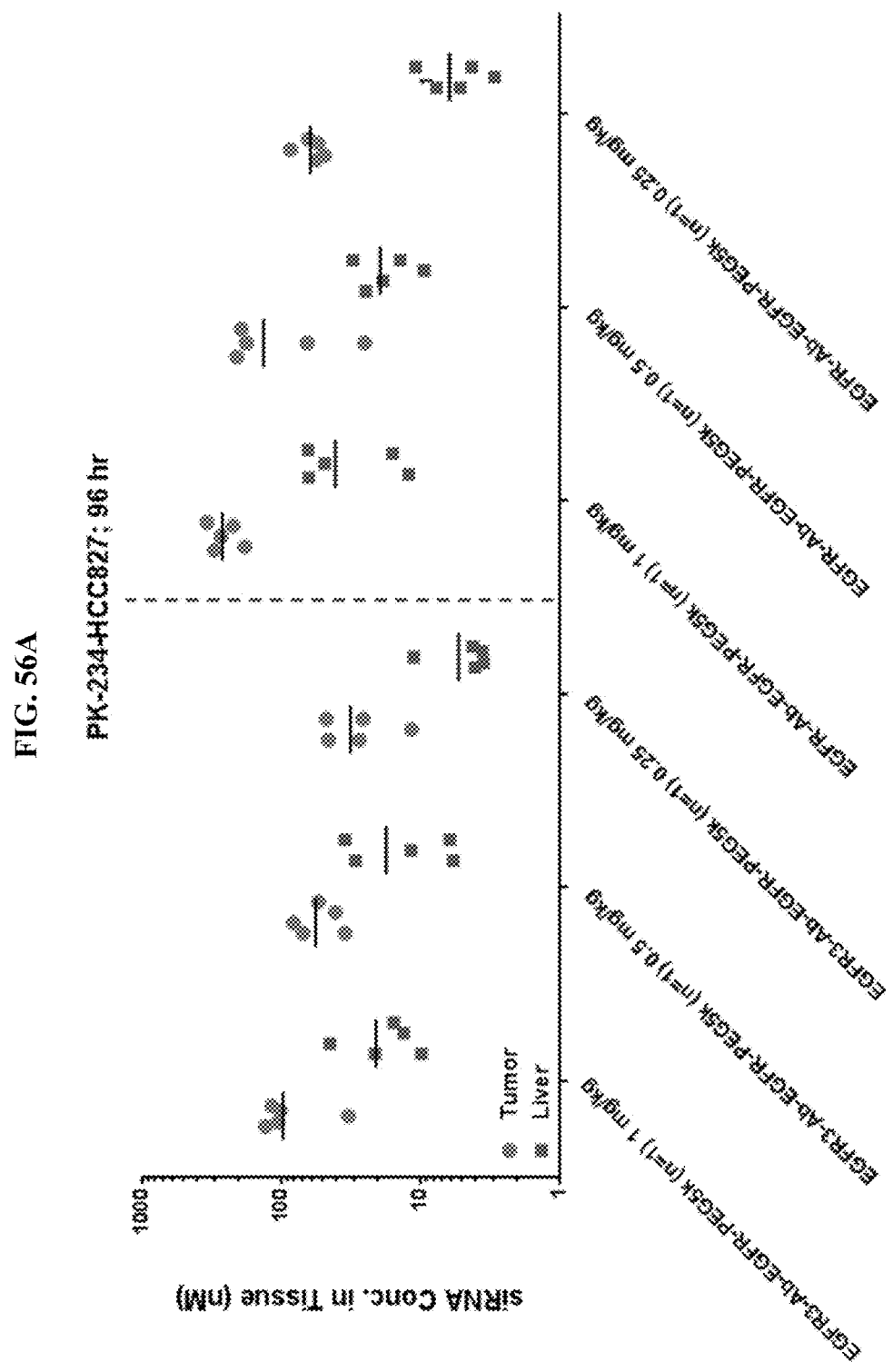
FIG. 56A illustrates siRNA concentration of exemplary molecules described herein in HCC827 tumor or liver tissue.
Figure 56B:
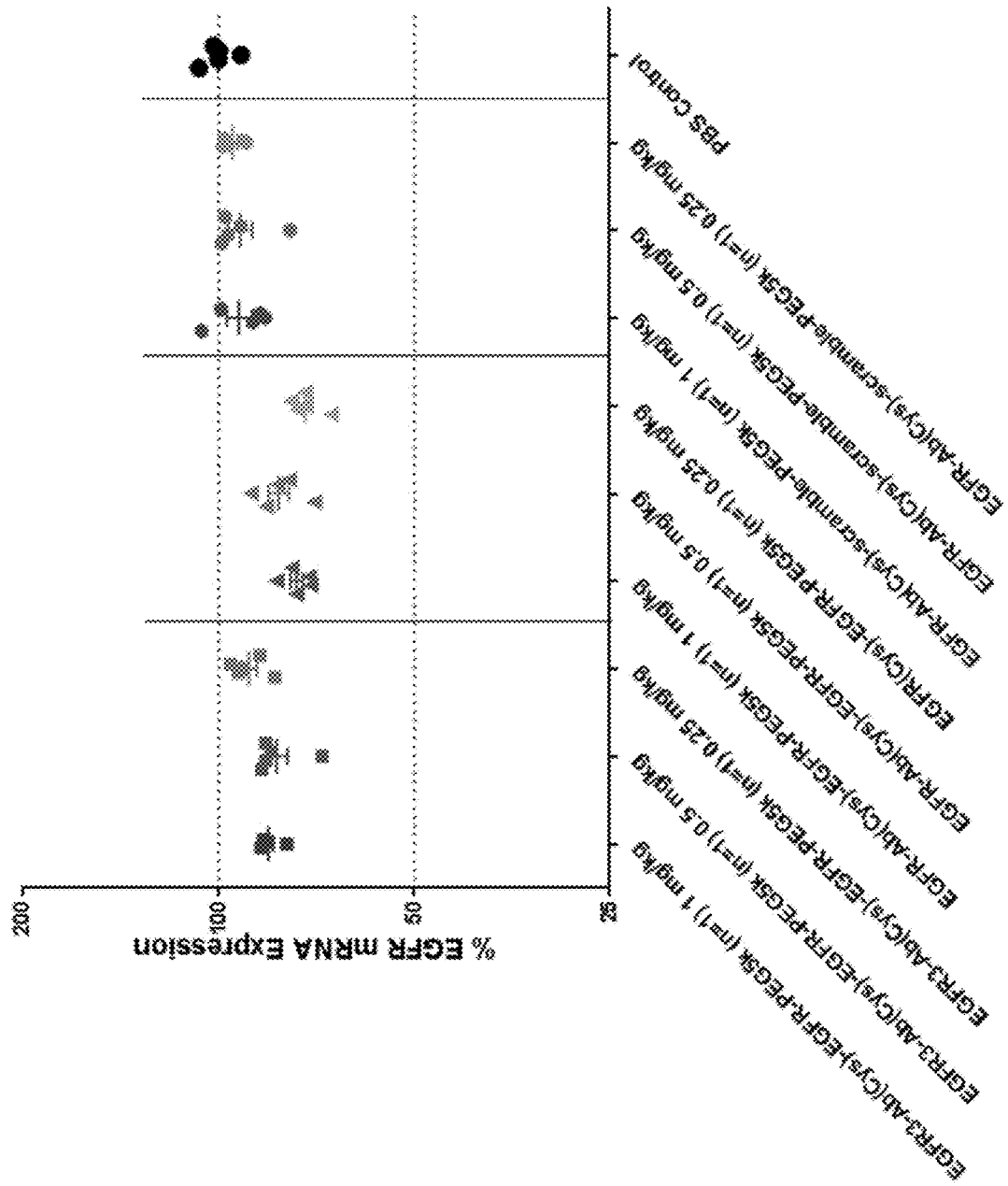
FIG. 56B shows EGFR mRNA expression level of exemplary molecules described herein.

| Group | Test Article | N | siRNA Dose (mg/kg) | ROA | Dose Volume (mL/kg) | # of Doses | Harvest Time (h) |
|---|---|---|---|---|---|---|---|
| 1 | EGFR3-Ab(Cys)-N3'-EGFR-5'S-PEG5k (n = 1) | 5 | 1 | IV | 5.0 | 1 | 96 |
| 2 | EGFR3-Ab(Cys)-N3'-EGFR-5'S-PEG5k (n = 1) | 5 | 0.5 | IV | 5.0 | 1 | 96 |
| 3 | EGFR3-Ab(Cys)-N3'-EGFR-5'S-PEG5k (n = 1) | 5 | 0.25 | IV | 5.0 | 1 | 96 |
| 4 | EGFR-Ab(Cys)-N5'-EGFR-3'S-PEG5k (n = 1) | 5 | 1 | IV | 5.0 | 1 | 96 |
| 5 | EGFR-Ab(Cys)-N5'-EGFR-3'S-PEG5k (n = 1) | 5 | 0.5 | IV | 5.0 | 1 | 96 |
| 6 | EGFR-Ab(Cys)-N5'-EGFR-3'S-PEG5k (n = 1) | 5 | 0.25 | IV | 5.0 | 1 | 96 |
| 7 | EGFR-Ab(Cys)-N5'-scramble-3'S-PEG5k (n = 1) | 5 | 1 | IV | 5.0 | 1 | 96 |
| 8 | EGFR-Ab(Cys)-N5'-scramble-3'S-PEG5k (n = 1) | 5 | 0.5 | IV | 5.0 | 1 | 96 |
| 9 | EGFR-Ab(Cys)-N5'-scramble-3'S-PEG5k (n = 1) | 5 | 0.25 | IV | 5.0 | 1 | 96 |
| 10 | PBS Control | 5 | — | IV | 5.0 | 1 | 96 |
| | Total # of Animals: | 50 | nu/nu mice with HCC827 tumors | | | | | siRNA concentrations were determined 96 hours in the tumor and liver after a single i.v. injection at 1.0, 0.5 and 0.25 mg/kg. Tissue concentrations were measured pmol/g and then converted to pmol/mL by assuming the density of tissue equals 1 g/mL. In FIG. 56A, a concentration of 1 nM=1 nmol/L=1 pmol/mL=1 pmol/g tissue. As illustrated in FIG. 56A, both antibody conjugates were capable of delivering higher levels of siRNA to the tumor relative to the liver, and a dose response was observed. Both conjugates were capable of EGFR gene specific mRNA knockdown at 96 hours post-administration relative to the scramble and vehicle control. See FIG. 56B.

As highlighted in FIG. 54, it was demonstrated biological activity with the A-X-B—Y-C conjugate with a range of different antibodies and siRNA cargos that are capable of in vivo biological activity in a range of different tissue targets. In this example, it was demonstrated tumor specific accumulation of 2 conjugates targeted with two different EGFR antibodies conjugated to an siRNA designed to down regulate EGFR mRNA. The HCC827 tumor expresses high levels of human EGFR and both conjugates have a human specific EGFR antibody to target the siRNA, resulting in tumor tissue specific accumulation of the conjugates. Receptor mediate uptake resulted in siRNA mediated knockdown of the target gene Example 16: 2016-PK-237-HCC827 siRNA Design and Synthesis

KRAS: A 21mer duplex with 19 bases of complementarity and 3' dinucleotide overhangs was designed against human KRAS. The sequence of the guide/antisense strand was complementary to the gene sequence starting a base position 237 for the human mRNA transcript for KRAS (UGAAUUAGCUGUAUCGUCAUU; SEQ ID NO: 2088). Base, sugar and phosphate modifications were used to optimize the potency of the duplex and reduce immunogenicity. All siRNA single strands were fully assembled on solid phase using standard phospharamidite chemistry and purified over HPLC. Purified single strands were duplexed to get the double stranded siRNA. The passenger strand contained two conjugation handles, a C6-SH at the 3' end, which was connected to siRNA passenger strand via phosphodiester-inverted abasic-phosphorothioate linker. The C6-SH was connected through the phosphodiester, see Example 9 for the chemical structure. In addition, the 5' end of the passenger strand had the inverted abasic removed and the antibody was conjugated directly to the amine on passenger strand 5' end sugar on a T base using a procedure similar to architecture 2, see Example 9.

EFGR: A 21mer duplex with 19 bases of complementarity and 3' dinucleotide overhangs was designed against human EGFR. The sequence of the guide/antisense strand was complementary to the gene sequence starting a base position 333 for the human mRNA transcript for EGFR (ACUCGUGCCUUGGCAAACUUU; SEQ ID NO: 2082). Base, sugar and phosphate modifications were used to optimize the potency of the duplex and reduce immunogenicity. All siRNA single strands were fully assembled on solid phase using standard phospharamidite chemistry and purified over HPLC. Purified single strands were duplexed to get the double stranded siRNA. The passenger strand contained two conjugation handles, a C6-NH2 at the 5' end and a C6-SH at the 3' end. Both conjugation handles were connected to siRNA passenger strand via phosphorothioate-inverted abasic-phosphorothioate linker, see Example 9 for the chemical structure.

ASC Synthesis and Characterization

Conjugates in groups 1-3 were made and purified as a DAR1 (n=1) using ASC architecture-7, as described in Example 9.

Conjugates in groups 4-6 were made and purified as a DAR1 (n=1) using ASC architecture-4, as described in Example 9.

In Vivo Study Design

Groups (n=5) of female NCr nu/nu mice bearing subcutaneously (SC) flank HCC827 tumors 100-300 $mm^3$ in volume were treated with one intravenous (i.v.) tail vein injection of siRNA conjugate, while control group 7 (n=5) of the same mice received one i.v. injection of PBS as a vehicle control. Treatment groups 1-3, 4-6 were dosed at 1.0, 0.5 or 0.25 mg/kg (based on the weight of siRNA), as per the study design below. As described in Example 9, groups 1-6 contained the same targeting antibody (EGFR) but groups 1-3 had an siRNA designed to downregulate KRAS and groups 4-6 had an siRNA designed to downregulate EGFR. All groups (treatments and controls) were administered a dose volume of 5 mL/kg. Mice were sacrificed by $CO_2$ asphyxiation at 96 hours post-dose. Table 28 describes the study design in more detail. 50 mg pieces of tumor and liver, were collected and snap-frozen in liquid nitrogen. mRNA knockdown in target tissue was determined using a comparative qPCR assay as described in the methods section. Total RNA was extracted from the tissue, reverse transcribed and mRNA levels were quantified using TaqMan qPCR, using the appropriately designed primers and probes. PPIB (housekeeping gene) was used as an internal RNA loading control, results were calculated by the comparative Ct method, where the difference between the target gene Ct value and the PPIB Ct value ($\Delta$Ct) is calculated and then further normalized relative to the PBS control group by taking a second difference ($\Delta\Delta$Ct). Quantitation of tissue siRNA concentrations were determined using a stem-loop qPCR assay as described in Example 2. The antisense strand of the siRNA was reverse transcribed using a TaqMan MicroRNA reverse transcription kit using a sequence-specific stem-loop RT primer. The cDNA from the RT step was then utilized for real-time PCR and Ct values were transformed into plasma or tissue concentrations using the linear equations derived from the standard curves. Plasma concentrations of the antibody component of the conjugate were determined using an ELISA assay.

As highlighted in FIG. 54, it was demonstrated biological activity with the A-X-B—Y-C conjugate with a range of different antibodies and siRNA cargos that are capable of in vivo biological activity in a range of different tissue targets. In this example it was demonstrated tumor specific accumulation and siRNA mediated mRNA knockdown of a EGFR antibody conjugated to an siRNA designed to down regulate KRAS mRNA. The HCC827 tumor expresses high levels of human EGFR and the conjugate has a human specific EGFR antibody to target the siRNA, resulting in tumor tissue specific accumulation of the conjugates. Receptor mediate uptake resulted in siRNA mediated knockdown of the KRAS gene.

Example 17: 2016-PK-187-Hep3B siRNA Design and Synthesis

EFGR: A 21mer duplex with 19 bases of complementarity and 3' dinucleotide overhangs was designed against human EGFR. The sequence of the guide/antisense strand was complementary to the gene sequence starting a base position 333 for the human mRNA transcript for EGFR (ACUCGUGCCUUGGCAAACUUU; SEQ ID NO: 2082). Base, sugar and phosphate modifications were used to optimize the potency of the duplex and reduce immunogenicity. All siRNA single strands were fully assembled on solid phase using standard phospharamidite chemistry and purified over HPLC. Purified single strands were duplexed

TABLE 28

Figure 57A:
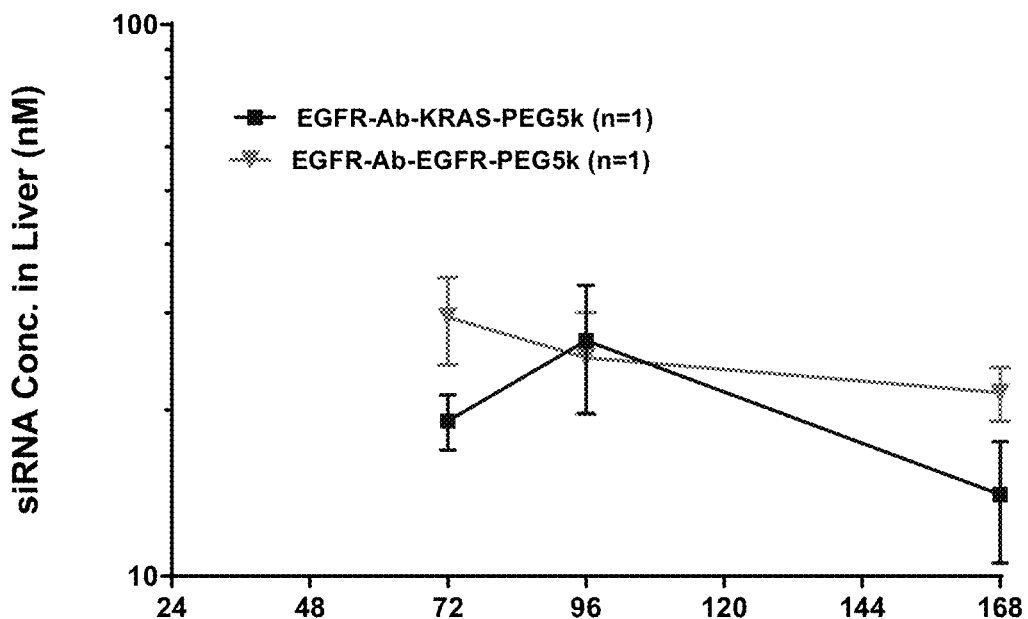
FIG. 57A-FIG. 57B illustrate siRNA concentration of exemplary molecules described herein in liver (FIG. 57A) and tumor (FIG. 57B).
Figure 57B:
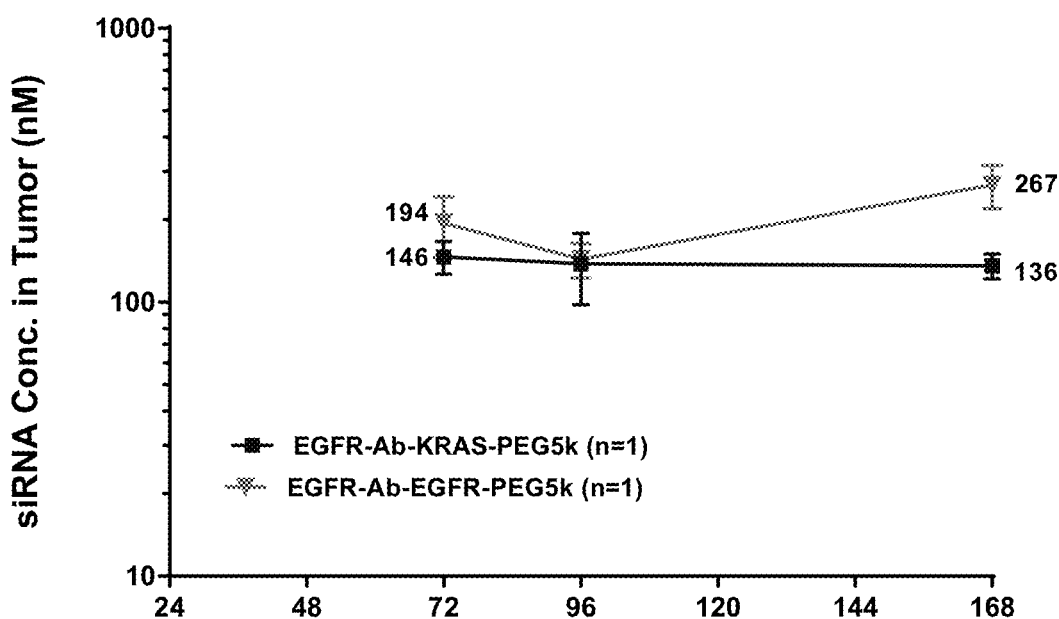
Figure 57C:
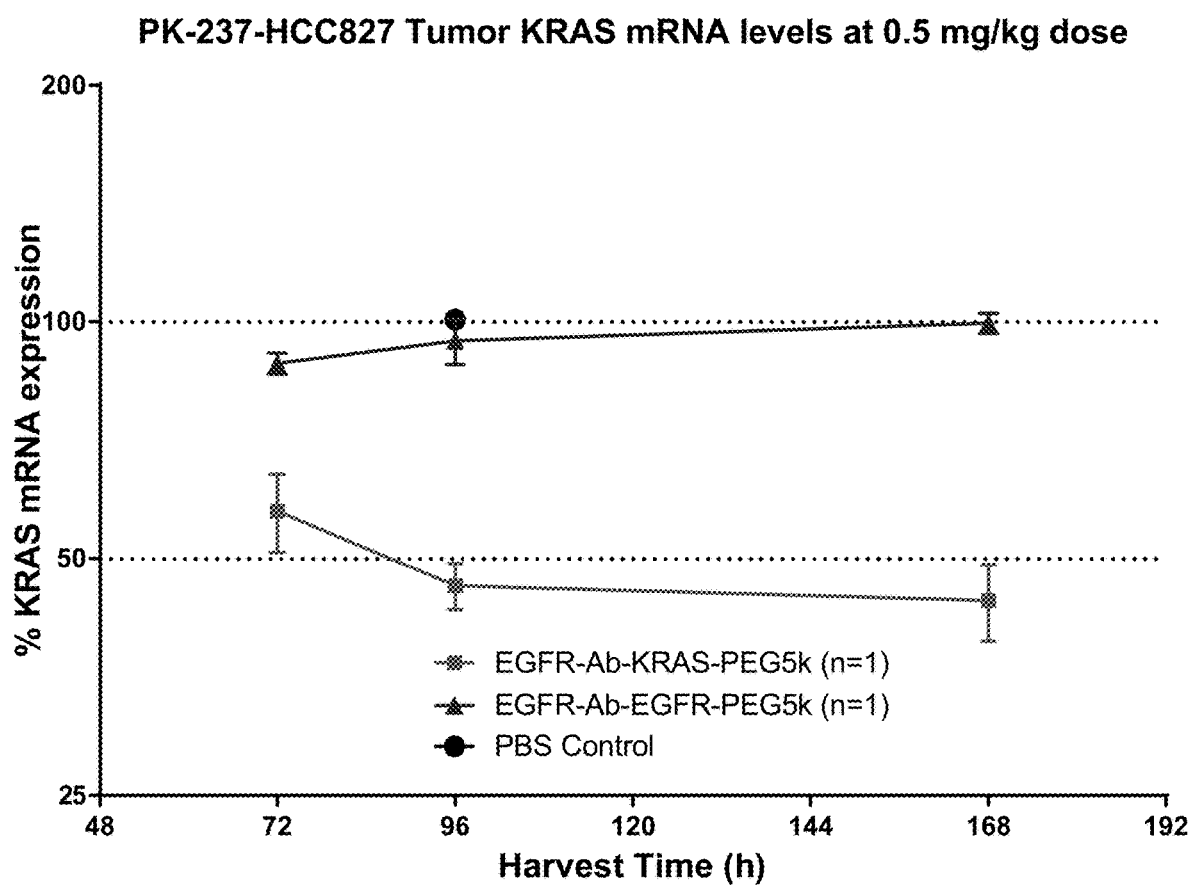
FIG. 57C shows KRAS mRNA expression level of exemplary molecules described herein.
Figure 58A:
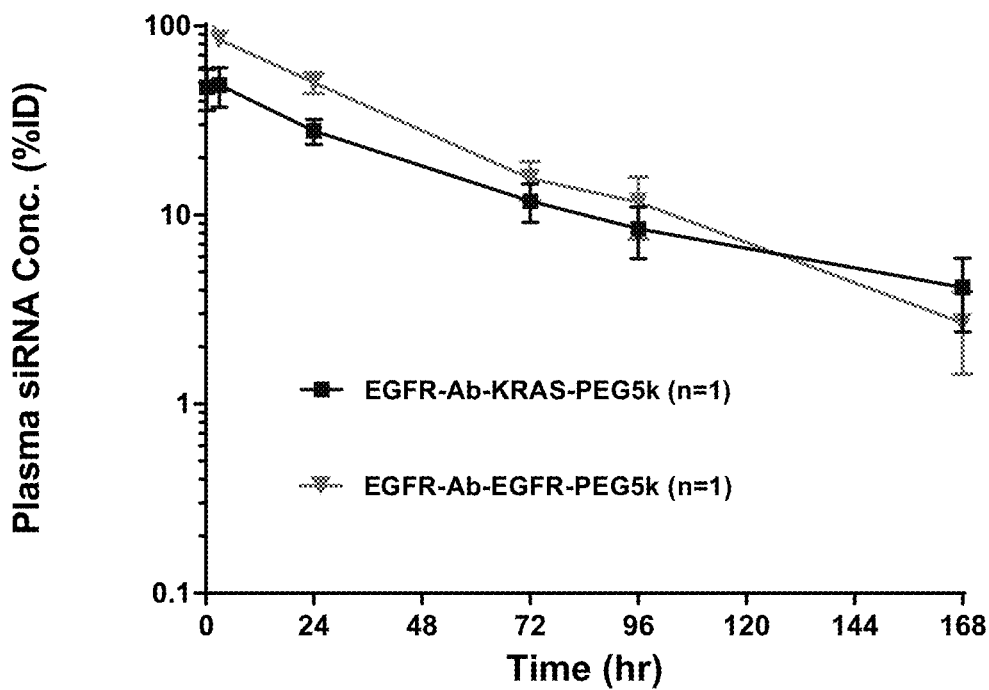
FIG. 58A illustrates plasma siRNA concentration of exemplary molecules described herein.
Figure 58B:
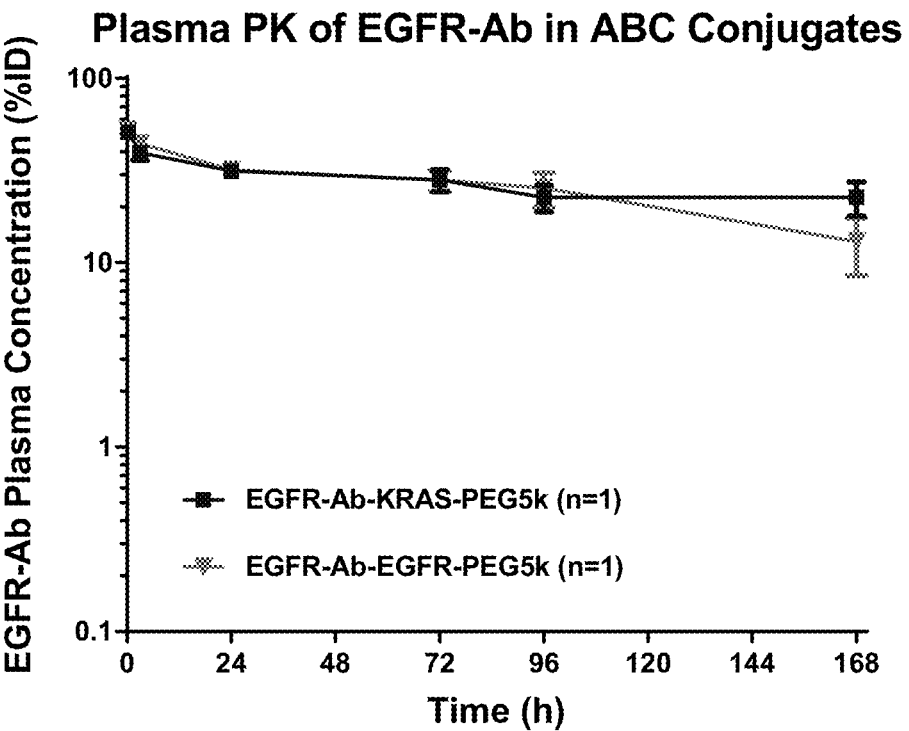
FIG. 58B shows plasma antibody concentration of exemplary molecules described herein.

| Group | Test Article | N | siRNA Dose (mg/kg) | ROA | Dose Volume (mL/kg) | # of Doses | Survival Bleed (min) | Terminal Bleed (h) | Harvest Time (h) |
|---|---|---|---|---|---|---|---|---|---|
| 1 | EGFR-Ab(Cys)-KRAS-PEG5k (n = 1) | 5 | 0.5 | IV | 5.0 | 1 | 0.25 | 72 | 72 |
| 2 | EGFR-Ab(Cys)-KRAS-PEG5k (n = 1) | 5 | 0.5 | IV | 5.0 | 1 | 3 | 96 | 96 |
| 3 | EGFR-Ab(Cys)-KRAS-PEG5k (n = 1) | 5 | 0.5 | IV | 5.0 | 1 | 24 | 168 | 168 |
| 4 | EGFR-Ab(Cys)-EGFR-PEG5k (n = 1) | 5 | 0.5 | IV | 5.0 | 1 | 0.25 | 72 | 72 |
| 5 | EGFR-Ab(Cys)-EGFR-PEG5k (n = 1) | 5 | 0.5 | IV | 5.0 | 1 | 3 | 96 | 96 |
| 6 | EGFR-Ab(Cys)-EGFR-PEG5k (n = 1) | 5 | 0.5 | IV | 5.0 | 1 | 24 | 168 | 168 |
| 7 | PBS Control | 5 | — | IV | 5.0 | 1 | — | — | 96 |
| | Total # of Animals: | 35 | | nu/nu mice with HCC827 tumors | | | | | | siRNA concentrations were determined 96 hours in the tumor and liver after a single i.v. injection at 1.0, 0.5 and 0.25 mg/kg. Tissue concentrations were measured pmol/g and then converted to pmol/mL by assuming the density of tissue equals 1 g/mL. In FIG. 57A and FIG. 57B, a concentration of 1 nM=1 nmol/L=1 pmol/mL=1 pmol/g tissue. As illustrated in FIG. 57A and FIG. 57B, both antibody conjugates were capable of delivering higher levels of siRNA to the tumor relative to the liver. The conjugate that contained the siRNA designed to downregulate KRAS was capable of KRAS gene specific mRNA knockdown (FIG. 57C) at 96 hours post-administration relative to the conjugate that contained the siRNA designed to down regulate EGFR or the PBS vehicle control. Both antibody conjugate constructs had similar PK properties (see FIG. 58A and FIG. 58B) indicating the alternative conjugation strategy used on the 5' guide strand for the antibody had no impact on this biological parameter.

to get the double stranded siRNA. The passenger strand contained two conjugation handles, a C6-NH2 at the 5' end and a C6-SH at the 3' end. Both conjugation handles were connected to si RNA passenger strand via phosphorothioate-inverted abasic-phosphorothioate linker, see Example 9 for the chemical structure.

Negative control siRNA sequence (scramble): A published (Burke et al. (2014) Pharm. Res., 31(12):3445-60) 21mer duplex with 19 bases of complementarity and 3' dinucleotide overhangs was used. The sequence (5' to 3') of the guide/antisense strand was UAUCGACGUGUCCAGC-UAGUU (SEQ ID NO: 2116). Base, sugar and phosphate modifications were used to reduce immunogenicity and were comparable to those used in the active siRNA. All siRNA single strands were fully assembled on solid phase using standard phospharamidite chemistry and purified over HPLC. Purified single strands were duplexed to get the double stranded siRNA. The passenger strand contained two conjugation handles, a C6-NH₂ at the 5' end and a C6-SH at the 3' end. Both conjugation handles were connected to siRNA passenger strand via a phosphodiester-inverted abasic-phosphodiester linker, see Example 9 for the chemical structure.

ASC Synthesis and Characterization

All conjugates were made and purified as a DAR1 (n=1) using ASC architecture-4, as described in Example 9.

In Vivo Study Design

Figure 59A:
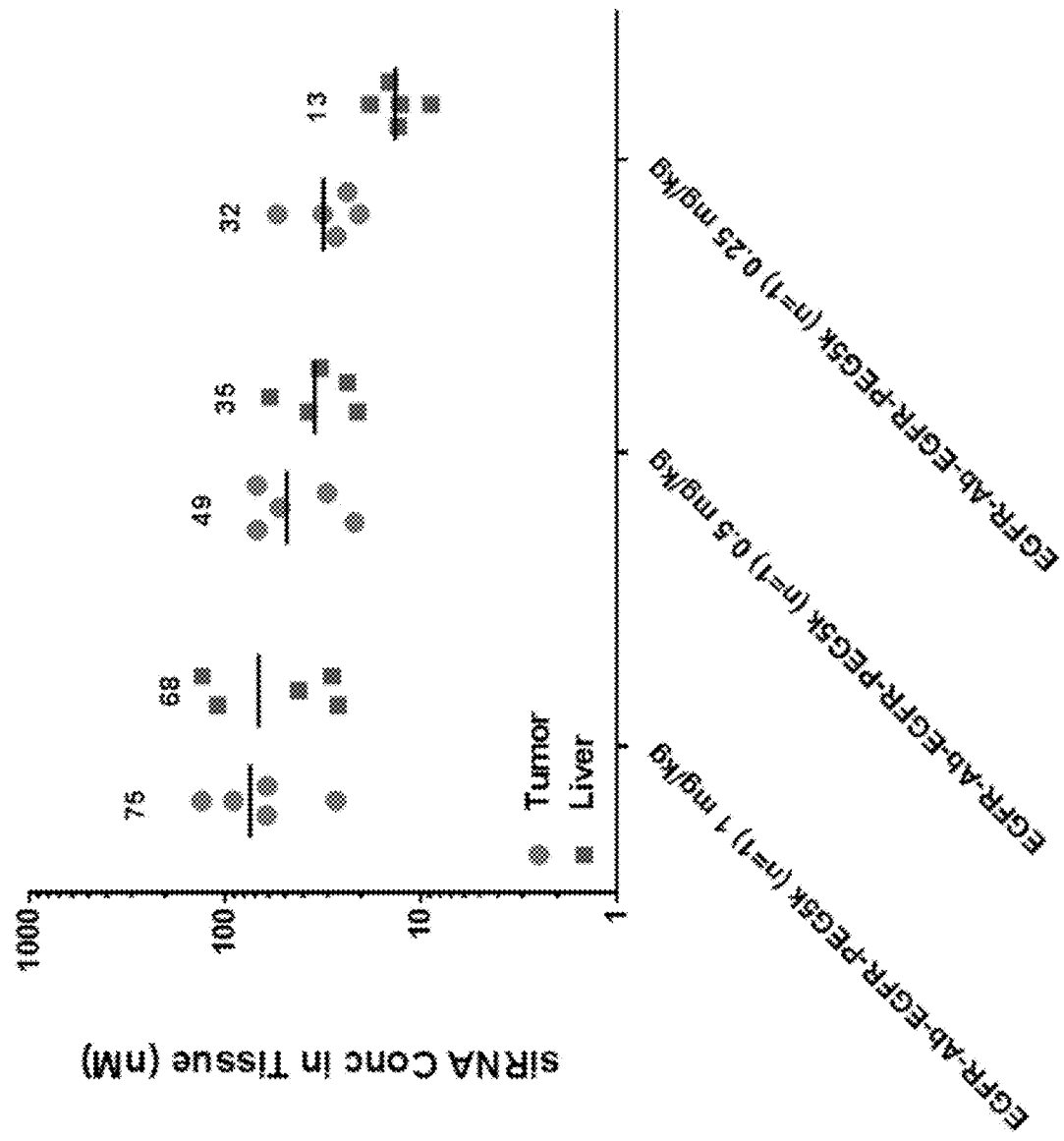
FIG. 59A illustrates siRNA concentration of exemplary molecules described herein in tumor or liver tissue.
Figure 59B:
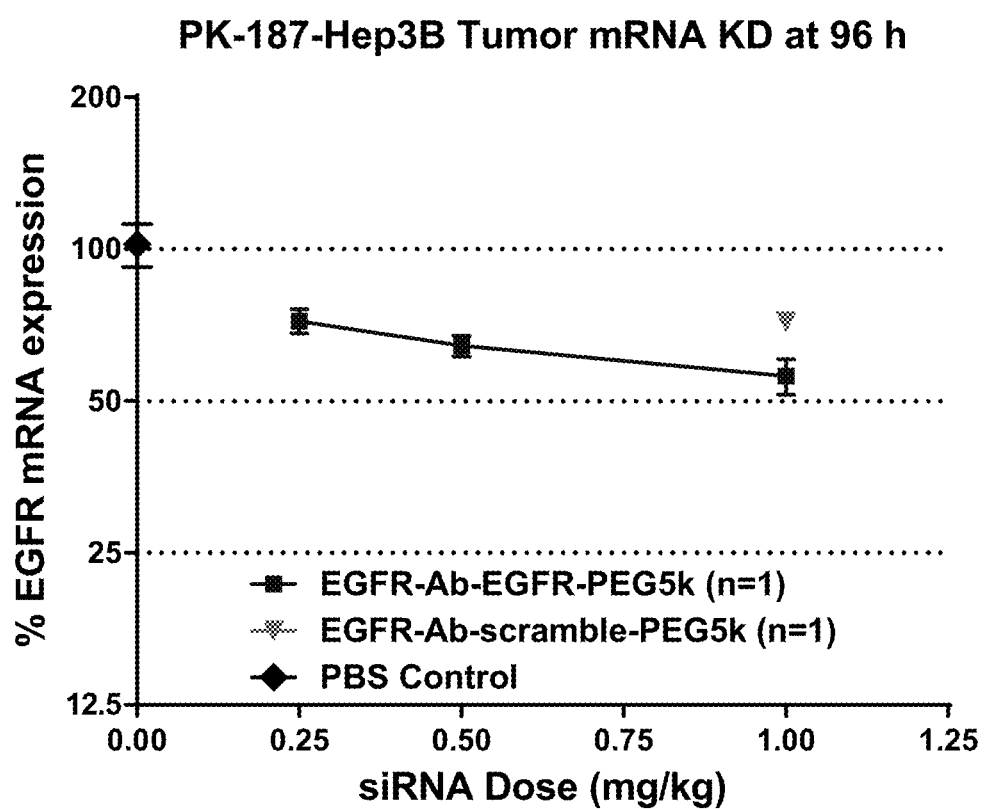
FIG. 59B shows mRNA expression level of exemplary molecules described herein in Hep3B tumor.

Groups (n=5) of female NCr nu/nu mice bearing subcutaneously (SC) flank Hep-3B2 1-7 tumors 100-300 mm³ in volume were treated with one intravenous (i.v.) tail vein injection of siRNA conjugate, while control group 5 (n=5) of the same mice received one i.v. injection of PBS as a vehicle control. Treatment groups 1-3 were dosed at 1.0, 0.5 or 0.25 mg/kg (based on the weight of siRNA), group 4 (scramble control) was dosed at 1.0 mg/kg, as per the study design below. Group 4 received an antibody conjugate with a negative control siRNA sequence (scramble) as a control for group 1. All groups (treatments and controls) were administered a dose volume of 5 mL/kg. Mice were sacrificed by $CO_2$ asphyxiation at 96 hours post-dose. Table 29 describes the study design in more detail. 50 mg pieces of tumor and liver, were collected and snap-frozen in liquid nitrogen. mRNA knockdown in target tissue was determined using a comparative qPCR assay as described in Example 2. Total RNA was extracted from the tissue, reverse transcribed and mRNA levels were quantified using TaqMan qPCR, using the appropriately designed primers and probes. PPIB (housekeeping gene) was used as an internal RNA loading control, results were calculated by the comparative Ct method, where the difference between the target gene Ct value and the PPIB Ct value ($\Delta$Ct) is calculated and then further normalized relative to the PBS control group by taking a second difference ($\Delta\Delta$Ct). Quantitation of tissue siRNA concentrations were determined using a stem-loop qPCR assay as described in Example 2. The antisense strand of the siRNA was reverse transcribed using a TaqMan MicroRNA reverse transcription kit using a sequence-specific stem-loop RT primer. The cDNA from the RT step was then utilized for real-time PCR and Ct values were transformed into plasma or tissue concentrations using the linear equations derived from the standard curves.

siRNA concentrations were determined 96 hours in the tumor and liver after a single i.v. injection at 1.0, 0.5 and 0.25 mg/kg. Tissue concentrations were measured pmol/g and then converted to pmol/mL by assuming the density of tissue equals 1 g/mL. In FIG. 59A, a concentration of 1 nM=1 nmol/L=1 pmol/mL=1 pmol/g tissue. As illustrated in FIG. 59A, the antibody conjugate was capable of delivering siRNA to the tumor. The conjugate was capable of EGFR gene specific mRNA knockdown (FIG. 59B) at 96 hours post-administration relative to the conjugate that contained the negative control siRNA sequence or the PBS vehicle control.

As highlighted in FIG. 54, it was demonstrated biological activity with the A-X-B—Y-C conjugate with a range of different antibodies and siRNA cargos that are capable of in vivo biological activity in a range of different tissue targets. In this example it was demonstrated tumor specific accumulation and siRNA mediated mRNA knockdown of an EGFR antibody conjugated to an siRNA designed to down regulate EGFR mRNA. The Hep-3B2 1-7 tumor cells express human EGFR and the conjugate has a human specific EGFR antibody to target the siRNA, resulting in tumor tissue specific accumulation of the conjugates. Receptor mediate uptake resulted in siRNA mediated knockdown of the EGFR gene.

Example 18: 2016-PK-257-WT siRNA Design and Synthesis

R1442: N5-CTNNB1-3'S

CTNNB1: A 21mer duplex with 19 bases of complementarity and 3' dinucleotide overhangs was designed against human CTNNB1. The sequence of the guide/antisense strand was complementary to the gene sequence starting a base position 1248 for the human mRNA transcript for CTNNB1 (UAAUGAGGACCUAUACUUAUU; SEQ ID NO: 2095). Base, sugar and phosphate modifications were used to optimize the potency of the duplex and reduce immunogenicity. All siRNA single strands were fully assembled on solid phase using standard phosphoramidite chemistry and purified over HPLC. Purified single strands were duplexed to get the double stranded siRNA. The passenger strand contained two conjugation handles, a C6-NH2 at the 5' end and a C6-SH at the 3' end. Both conjugation handles were connected to the siRNA passenger strand via phosphodiester-inverted abasic-phosphorothioate linker. The C6-NH2 and C6-SH were connected through the phosphodiester, see Example 9 for the chemical structure.

ASC Synthesis and Characterization

The antibody conjugate was made and purified as a DAR1 (n=1) using ASC architecture-1, as described in Example 9. The tri-GalNAc-CTNNB1 conjugate was made as described in Example 9.

In Vivo Study Design

Groups 1-3 (n=4) of wild-type female CD-1 mice were treated with one intravenous (i.v.) tail vein injections of siRNA conjugates, the GalNAc targeted control was doses by subcutaneous injection. Treatment groups 1-3 received doses of 2.0 1.0 and 0.5 mg/kg (based on the weight of siRNA) and the GalNAc targeted control conjugate was doses at 2 mg/kg. All groups were administered a dose volume of 5.0 mL/kg. Table 30 illustrates the study design in more detail. 50 mg pieces of liver were collected and

TABLE 29

| Group | Test Article | N | siRNA Dose (mg/kg) | ROA | Dose Volume (mL/kg) | # of Doses | Harvest Time (h) |
|---|---|---|---|---|---|---|---|
| 1 | EGFR-Ab(Cys)-EGFR-PEG5k (n = 1) | 5 | 1 | IV | 5.0 | 1 | 96 |
| 2 | EGFR-Ab(Cys)-EGFR-PEG5k (n = 1) | 5 | 0.5 | IV | 5.0 | 1 | 96 |
| 3 | EGFR-Ab(Cys)-EGFR-PEG5k (n = 1) | 5 | 0.25 | IV | 5.0 | 1 | 96 |
| 4 | EGFR-Ab(Cys)-scramble-PEG5k (n = 1) | 5 | 1 | IV | 5.0 | 1 | 96 |
| 5 | PBS Control | 5 | — | IV | 5.0 | 1 | 96 |
| | Total # of Animals: | 25 | | nu/nu mice with Hep3B tumors | | | | snap-frozen in liquid nitrogen. mRNA knockdown in target tissue was determined using a comparative qPCR assay as described in Example 2. Total RNA was extracted from the tissue, reverse transcribed and mRNA levels were quantified using TaqMan qPCR, using the appropriately designed primers and probes. PPIB (housekeeping gene) was used as an internal RNA loading control, results were calculated by the comparative Ct method, where the difference between the target gene Ct value and the PPIB Ct value (ΔCt) is calculated and then further normalized relative to the PBS control group by taking a second difference (ΔΔCt).

TABLE 30

| Group | Test Article | N | SiRNA Dose (mg/kg) | ROA | Dose Volume (mL/kg) | # of Doses | Harvest Time (h) |
|---|---|---|---|---|---|---|---|
| 1 | ASGR1-Ab(Lys)-CTNNB1-PEG5k (n = 1) | 4 | 2 | IV | 5.0 | 1 | 96 |
| 2 | ASGR1-Ab(Lys)-CTNNB1-PEG5k (n = 1) | 4 | 1 | IV | 5.0 | 1 | 96 |
| 3 | ASGR1-Ab(Lys)-CTNNB1-PEG5k (n = 1) | 4 | 0.5 | IV | 5.0 | 1 | 96 |
| 4 | 3GalNAc-CTNNB1 Control | 5 | 2 | s.c. | 5.0 | 1 | 96 |
| 5 | PBS Control | 5 | — | IV | 5.0 | 1 | 96 |
| | Total # of Animals: | 22 | | | | WT mice (CD-1) | |

Figure 60:
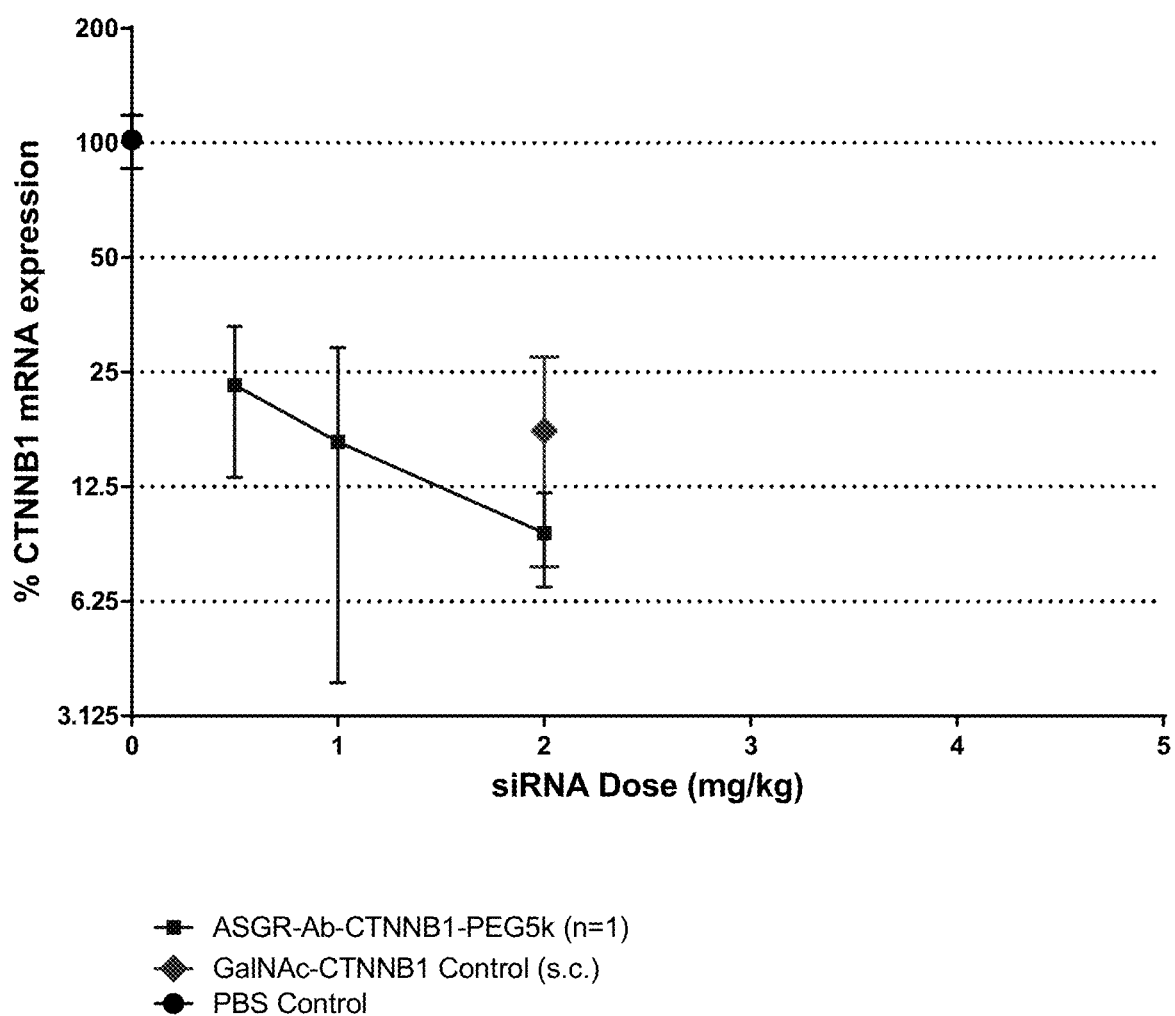
FIG. 60 shows CTNNB1 mRNA expression level of an exemplary molecule described herein in liver.

CTNNB1 gene knockdown was determined 96 hours post administration. As illustrated in FIG. 60, the GalNac-conjugated siRNA was capable of gene specific knockdown after a single s.c injection, as has been well described by others in the field. The same siRNA conjugated to an ASGR antibody was also capable of CTNNB1 gene specific down-regulation and in a dose dependent manner.

As highlighted in FIG. 54, it was demonstrated biological activity with the A-X-B—Y-C conjugate with a range of different antibodies and siRNA cargos that are capable of in vivo biological activity in a range of different tissue targets. In this example it was demonstrated liver delivery with an ASGR antibody conjugated to an siRNA designed to down regulate CTNNB1 mRNA. Mouse Liver cells express the asialoglycoprotein receptor (ASGR) and the conjugate has a mouse specific ASGR antibody to target the siRNA, resulting in siRNA mediated knockdown of the CTNNB1 in the liver.

Example 19: 2016-PK-253-WT siRNA Design and Synthesis

KRAS: A 21mer duplex with 19 bases of complementarity and 3' dinucleotide overhangs was designed against human KRAS. The sequence of the guide/antisense strand was complementary to the gene sequence starting a base position 237 for the human mRNA transcript for KRAS (UGAAUUAGCUGUAUCGUCAUU; SEQ ID NO: 2088). Base, sugar and phosphate modifications were used to optimize the potency of the duplex and reduce immunogenicity. All siRNA single strands were fully assembled on solid phase using standard phospharamidite chemistry and purified over HPLC. Purified single strands were duplexed to get the double stranded siRNA. The passenger strand contained two conjugation handles, a C6-NH2 at the 5' end and a C6-SH at the 3' end. Both conjugation handles were connected to siRNA passenger strand via phosphodiester-inverted abasic-phosphorothioate linker. The C6-NH2 and C6-SH were connected through the phosphodiester, see Example 9 for the chemical structure.

ASC Synthesis and Characterization

The antibody conjugate was made and purified as a DAR1 (n=1) using ASC architecture-1, as described in Example 9. The tri-GalNAc-CTNNB1 conjugate was made as described in Example 9.

In Vivo Study Design

Groups 1-3 (n=4) of wild-type female CD-1 mice were treated with one intravenous (i.v.) tail vein injections of siRNA conjugates, the GalNAc targeted control was doses by subcutaneous injection. Treatment groups 1-3 received doses of 2.0 1.0 and 0.5 mg/kg (based on the weight of siRNA) and the GalNAc targeted control conjugate was doses at 2 mg/kg. All groups were administered a dose volume of 5.0 mL/kg. Table 31 illustrates the study design in more detail. 50 mg pieces of liver were collected and snap-frozen in liquid nitrogen. mRNA knockdown in target tissue was determined using a comparative qPCR assay as described in Example 2. Total RNA was extracted from the tissue, reverse transcribed and mRNA levels were quantified using TaqMan qPCR, using the appropriately designed primers and probes. PPIB (housekeeping gene) was used as an internal RNA loading control, results were calculated by the comparative Ct method, where the difference between the target gene Ct value and the PPIB Ct value (ΔCt) is calculated and then further normalized relative to the PBS control group by taking a second difference (ΔΔCt).

TABLE 31

| Group | Test Article | N | SiRNA Dose (mg/kg) | ROA | Dose Volume (mL/kg) | # of Doses | Harvest Time (h) |
|---|---|---|---|---|---|---|---|
| 1 | ASGR2-Ab(Lys)-KRAS-PEG5k (n = 1) | 4 | 2 | IV | 5.0 | 1 | 96 |
| 2 | ASGR2-Ab(Lys)-KRAS-PEG5k (n = 1) | 4 | 1 | IV | 5.0 | 1 | 96 |

TABLE 31-continued

| Group | Test Article | N | SiRNA Dose (mg/kg) | ROA | Dose Volume (mL/kg) | # of Doses | Harvest Time (h) |
|---|---|---|---|---|---|---|---|
| 3 | ASGR2-Ab(Lys)-KRAS-PEG5k (n = 1) | 4 | 0.5 | IV | 5.0 | 1 | 96 |
| 4 | 3GalNAc-KRAS Control | 5 | 2 | s.c. | 5.0 | 1 | 96 |
|   | PBS Control | 5 | — | IV | 5.0 | 1 | 96 |
|   | Total # of Animals: | 22 |   |   | WT mice (CD-1) |   |   |

Figure 61:
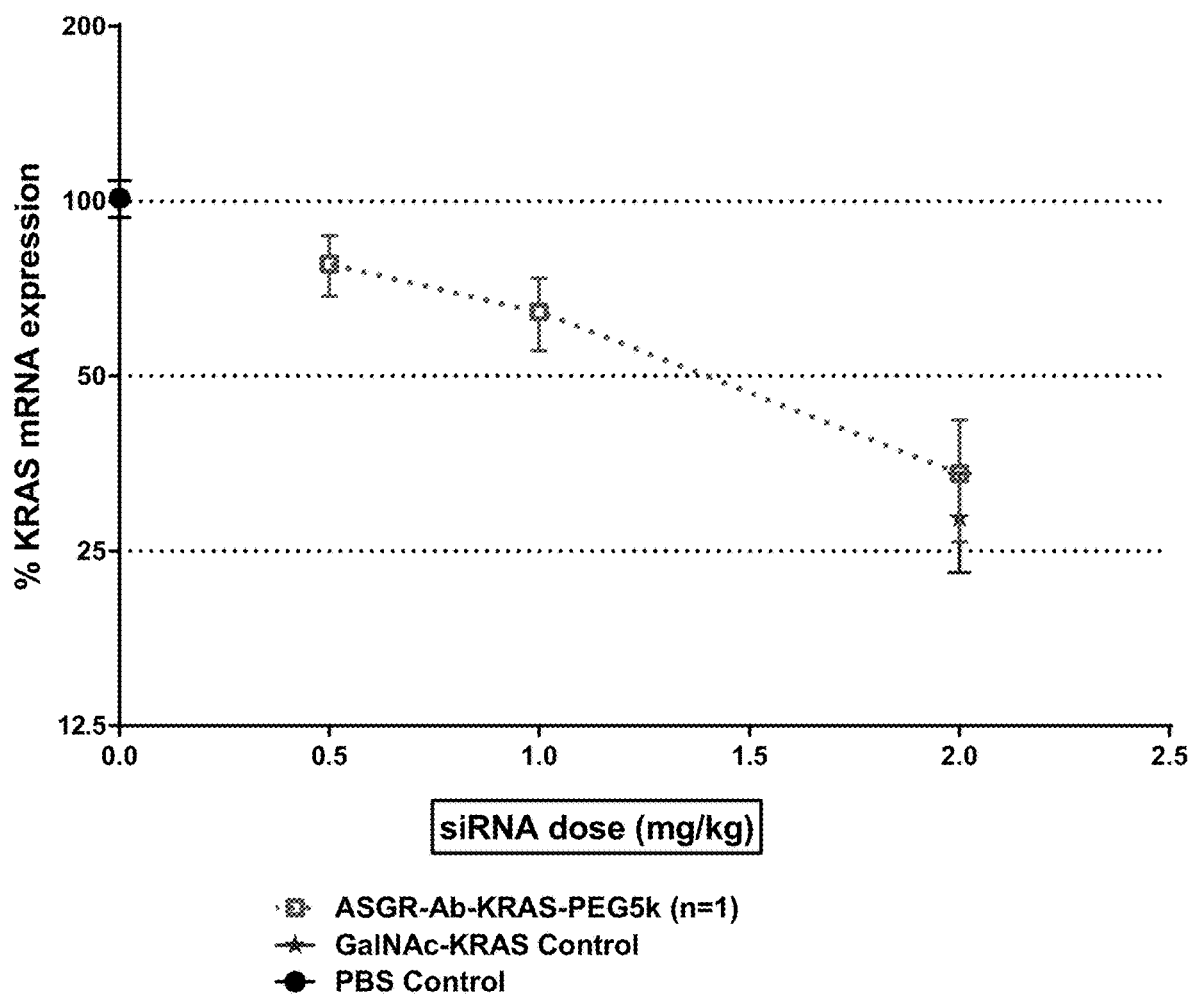
FIG. 61 shows KRAS mRNA expression level of an exemplary molecule described herein in liver.

KRAS gene knockdown was determined 96 hours post administration. As illustrated in FIG. 61, the GalNac-conjugated siRNA was capable of gene specific knockdown after a single s.c injection, as has been well described by others in the field. The same siRNA conjugated to an ASGR antibody was also capable of KRAS gene specific down-regulation and in a dose dependent manner.

As highlighted in FIG. 54, it was demonstrated biological activity with the A-X-B—Y-C conjugate with a range of different antibodies and siRNA cargos that are capable of in vivo biological activity in a range of different tissue targets. In this example it was demonstrated liver delivery with an ASGR antibody conjugated to an siRNA designed to down regulate KRAS mRNA. Mouse Liver cells express the asialoglycoprotein receptor (ASGR) and the conjugate has a mouse specific ASGR antibody to target the siRNA, resulting in siRNA mediated knockdown of the KRAS in the liver Example 20: 2016-PK-129-WT-plasma siRNA Design and Synthesis KRAS: A 21mer duplex with 19 bases of complementarity and 3' dinucleotide overhangs was designed against human KRAS. The sequence of the guide/antisense strand was complementary to the gene sequence starting a base position 237 for the human mRNA transcript for KRAS (UGAAUUAGCUGUAUCGUCAUU; SEQ ID NO: 2088). Base, sugar and phosphate modifications were used to optimize the potency of the duplex and reduce immunogenicity. All siRNA single strands were fully assembled on solid phase using standard phospharamidite chemistry and purified over HPLC. Purified single strands were duplexed to get the double stranded siRNA. The passenger strand contained two conjugation handles, a C6-NH2 at the 5' end and a C6-SH at the 3' end. Both conjugation handles were connected to siRNA passenger strand via a phosphodiester-inverted abasic-phosphodiester linker, see Example 9 for the chemical structure.

EFGR: A 21mer duplex with 19 bases of complementarity and 3' dinucleotide overhangs was designed against human EGFR. The sequence of the guide/antisense strand was complementary to the gene sequence starting a base position 333 for the human mRNA transcript for EGFR (ACUCGUGCCUUGGCAAACUUU; SEQ ID NO: 2082). Base, sugar and phosphate modifications were used to optimize the potency of the duplex and reduce immunogenicity. All siRNA single strands were fully assembled on solid phase using standard phospharamidite chemistry and purified over HPLC. Purified single strands were duplexed to get the double stranded siRNA. The passenger strand contained two conjugation handles, a C6-NH$_2$ at the 5' end and a C6-SH at the 3' end. Both conjugation handles were connected to siRNA passenger strand via phosphorothioate-inverted abasic-phosphorothioate linker, see Example 9 for the chemical structure.

ASC Synthesis and Characterization

All conjugates were made and purified as a DAR1 (n=1) using ASC architecture-1, as described in Example 9.

In Vivo Study Design

Groups (n=3) of wild-type female CD-1 mice were treated with one intravenous (i.v.) tail vein injections of siRNA conjugates. Treatment groups received 0.5 mg/kg (based on the weight of siRNA) and all groups were administered a dose volume of 5.0 mL/kg. Table 32 illustrates the study design in more detail. Non-terminal blood samples were collected at 5, 30, and 180 minutes post-dose via puncture of the retro-orbital plexus and centrifuged to generate plasma for PK analysis. Mice were sacrificed by $CO_2$ asphyxiation at 24, 96, or 168 h post-dose. Terminal blood samples were collected via cardiac puncture and processed to generate plasma for PK analysis. Quantitation of plasma siRNA concentrations were determined using a stem-loop qPCR assay as described in Example 2. The antisense strand of the siRNA was reverse transcribed using a TaqMan MicroRNA reverse transcription kit using a sequence-specific stem-loop RT primer. The cDNA from the RT step was then utilized for real-time PCR and Ct values were transformed into plasma or tissue concentrations using the linear equations derived from the standard curves. Plasma concentrations of antibody were determined using an ELISA assay.

TABLE 32

| Group | Test Article | N | siRNA Dose (mg/kg) | ROA | Dose Volume (mL/kg) | # of Doses | Survival Bleed (min) | Terminal Bleed (h) |
|---|---|---|---|---|---|---|---|---|
| 1 | EGFR2-Ab(Lys)- | 3 | 0.5 | IV | 5.0 | 1 | 5 | 24 |
| 2 | KRAS-PEG5k | 3 | 0.5 | IV | 5.0 | 1 | 30 | 96 |
| 3 | (N = 1) | 3 | 0.5 | IV | 5.0 | 1 | 180 | 168 |
| 4 | PSMA-Ab(Lys)- | 3 | 0.5 | IV | 5.0 | 1 | 5 | 24 |
| 5 | EGFR-PEG5k | 3 | 0.5 | IV | 5.0 | 1 | 30 | 96 |
| 6 | (N = 1) | 3 | 0.5 | IV | 5.0 | 1 | 180 | 168 |
|   | Total # of Animals: | 18 |   |   | WT mice CD-1 |   |   |   |

Figure 62:
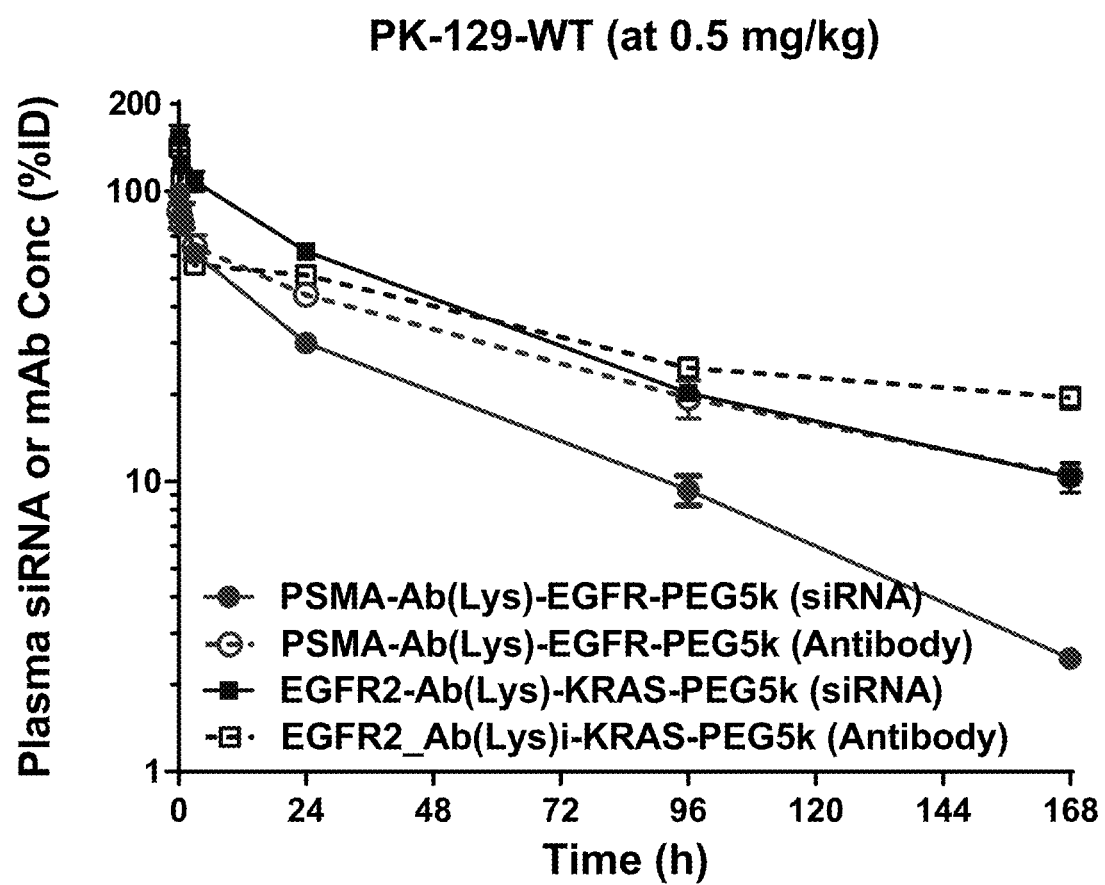
FIG. 62 illustrates plasma siRNA or monoclonal antibody (mAb) concentration of exemplary molecules described herein.

In this in vivo PK experiment the plasma clearance of two different conjugates was explored. As illustrated in FIG. 62, both the mAb-siRNA conjugates had comparable plasma PK when comparing the plasma levels of the siRNA (KRAS vs EGFR) or the antibody (EGFR2 vs PSMA).

As highlighted in FIG. 54, it was demonstrated biological activity with the A-X-B—Y-C conjugate with a range of different antibodies and siRNA cargos that are capable of in vivo biological activity in a range of different tissue targets. In this example it was demonstrated that two different conjugates with different antibody targeting ligands and different siRNA cargos have comparable plasma PK properties.

Example 21: 2016-PK-123-LNCaP siRNA Design and Synthesis

EFGR: A 21mer duplex with 19 bases of complementarity and 3' dinucleotide overhangs was designed against human EGFR. The sequence of the guide/antisense strand was complementary to the gene sequence starting a base position 333 for the human mRNA transcript for EGFR (ACUCGUGCCUUGGCAAACUUU; SEQ ID NO: 2082). Base, sugar and phosphate modifications were used to optimize the potency of the duplex and reduce immunogenicity. All siRNA single strands were fully assembled on solid phase using standard phosphoramidite chemistry and purified over HPLC. Purified single strands were duplexed to get the double stranded siRNA. The passenger strand contained two conjugation handles, a C6-NH2 at the 5' end and a C6-SH at the 3' end. Both conjugation handles were connected to siRNA passenger strand via phosphorothioate-inverted abasic-phosphorothioate linker, see Example 9 for the chemical structure.

ASC Synthesis and Characterization

All conjugates were made and purified as a DAR1 (n=1) or DAR2 (n=2) using ASC architecture-1, as described in Example 9.

In Vivo Study Design

Groups (n=5) of female SCID SHO mice bearing subcutaneous flank LNCaP tumors 100-350 mm³ in volume were treated with one intravenous (i.v.) tail vein injection of siRNA conjugate, while control groups (n=5) of the same mice received one i.v. injection of PBS as a vehicle control. Treatment groups were dosed as per the study design in Table 33. All groups (treatments and controls) were administered a dose volume of 5.71 mL/kg. Mice were sacrificed by $CO_2$ asphyxiation at 72 hours post-dose. 50 mg pieces of tumor and liver, were collected and snap-frozen in liquid nitrogen. mRNA knockdown in target tissue was determined using a comparative qPCR assay as described in Example 2. Total RNA was extracted from the tissue, reverse transcribed and mRNA levels were quantified using TaqMan qPCR, using the appropriately designed primers and probes. PPIB (housekeeping gene) was used as an internal RNA loading control, results were calculated by the comparative Ct method, where the difference between the target gene Ct value and the PPIB Ct value ($\Delta$Ct) is calculated and then further normalized relative to the PBS control group by taking a second difference ($\Delta\Delta$Ct). Quantitation of tissue siRNA concentrations were determined using a stem-loop qPCR assay as described in Example 2. The antisense strand of the siRNA was reverse transcribed using a TaqMan MicroRNA reverse transcription kit using a sequence-specific stem-loop RT primer. The cDNA from the RT step was then utilized for real-time PCR and Ct values were transformed into plasma or tissue concentrations using the linear equations derived from the standard curves.

TABLE 33

| Group | Test Article | N | SiRNA Dose (mg/kg) | ROA | Dose Volume (mL/kg) | # of Doses | Harvest Time (h) |
|---|---|---|---|---|---|---|---|
| 1 | PSMA-Ab(Lys)- | 5 | 2 | IV | 5.71 | 1 | 72 |
| 2 | EGFR-PEG5k | 5 | 1 | IV | 5.71 | 1 | 72 |
| 3 | (n = 1) | 5 | 0.5 | IV | 5.71 | 1 | 72 |
| 4 | PSMA-Ab(Lys)- | 5 | 4 | IV | 5.71 | 1 | 72 |
| 5 | EGFR-PEG5k | 5 | 2 | IV | 5.71 | 1 | 72 |
| 6 | (n = 2) | 5 | 1 | IV | 5.71 | 1 | 72 |
| 7 | PSMA-Ab(Lys)-Scramble-PEG5k (n = 1) | 5 | 2 | IV | 5.71 | 1 | 72 |
| 8 | EGFR siRNA Alone | 5 | 2 | IV | 5.71 | 1 | 72 |
| 9 | Vehicle | 5 | — | IV | 5.71 | 1 | 72 |

Figure 63A:
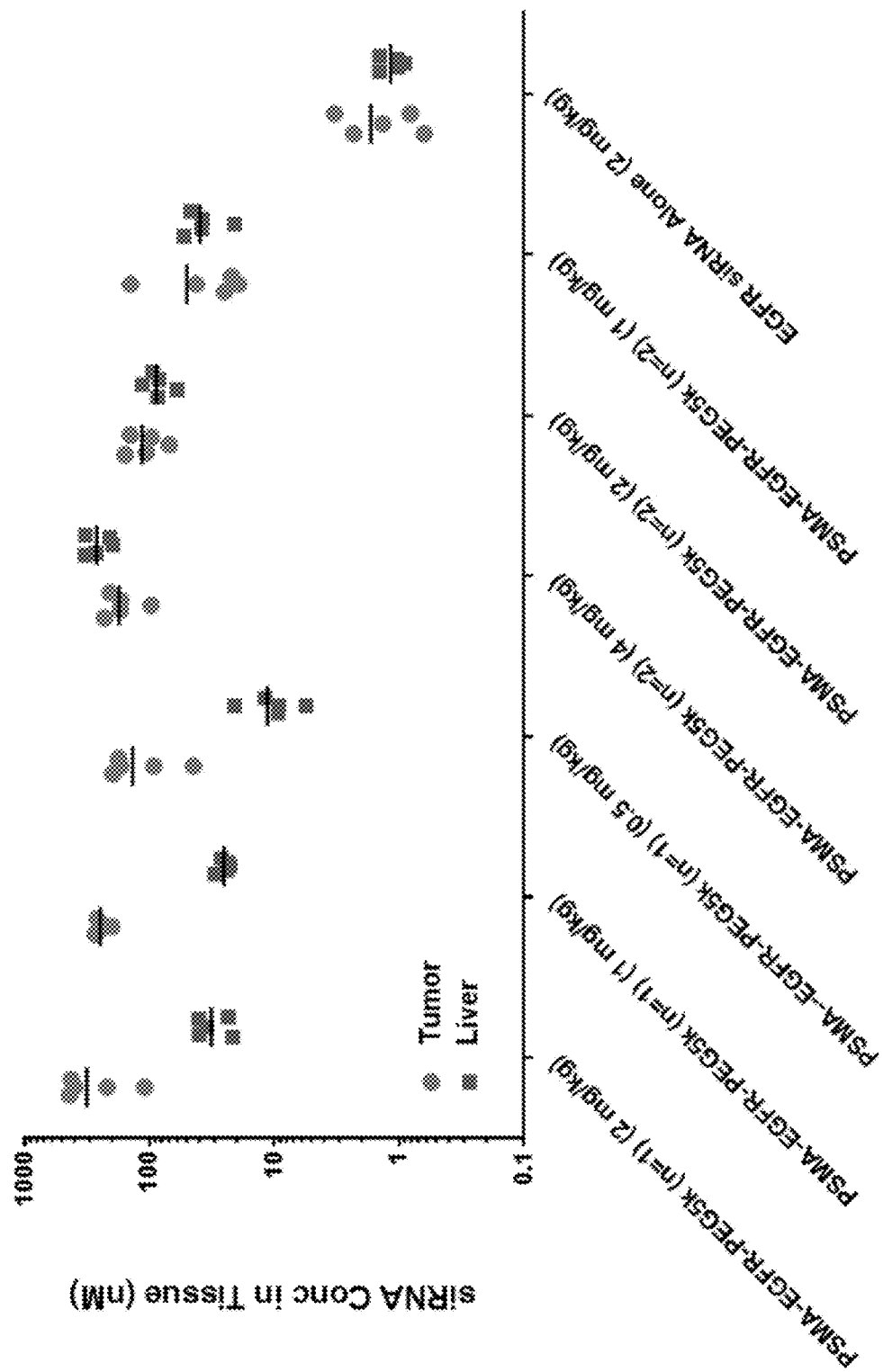
FIG. 63A illustrates siRNA concentration of exemplary molecules described herein in tumor or liver tissue.
Figure 63B:
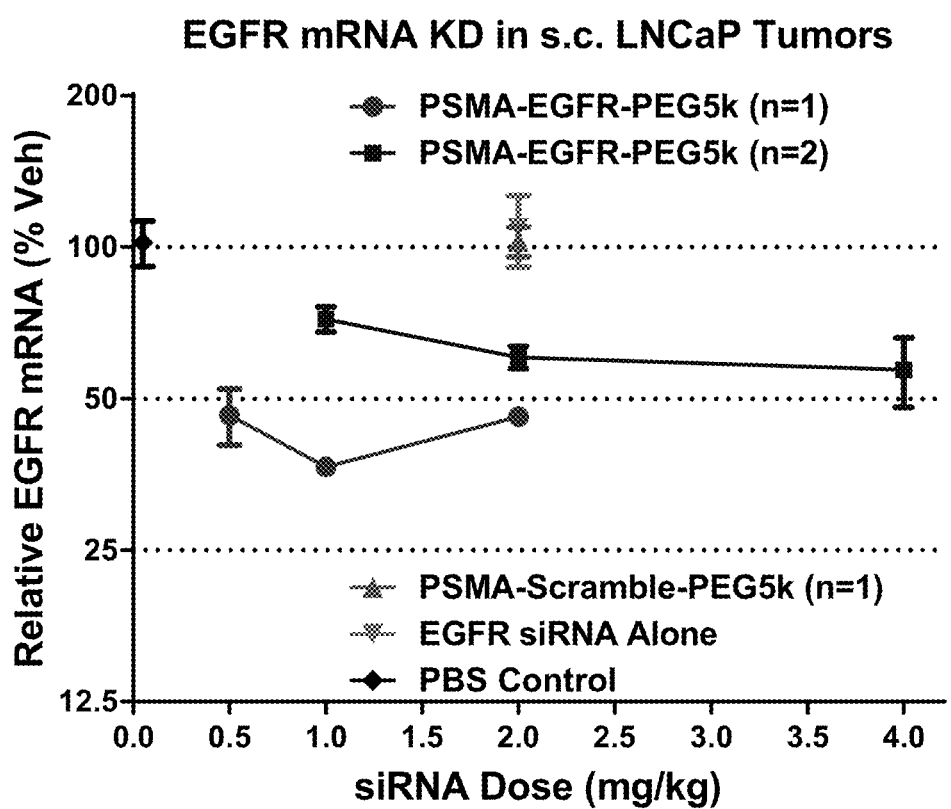
FIG. 63B shows EGFR mRNA expression level of exemplary molecules described herein in LNCaP tumor.

Total # of Animals: 45   SCID SHO mice with LNCaP tumors siRNA concentrations were determined 72 hours in the tumor and liver after a single i.v. injection, see FIG. 63A. As illustrated in FIG. 63A, the antibody conjugate with a drug to antibody ratio of 1 (n=1) was capable of delivering siRNA to the tumor in a dose dependent manner, at levels greater than measured in the liver and produced EGFR gene specific mRNA knockdown relative to the scrambled and PBS controls. This is in contrast to the antibody conjugate with a drug to antibody ratio of 2 (n=2), which achieved lower concentrations of siRNA in the tumor at an equivalent dose, liver and tumor concentrations which were of the same magnitude and a lower levels of EGFR knockdown. The unconjugated siRNA had poor tumor and liver accumulation and no measurable EGFR mRNA knockdown. FIG. 63B illustrates relative percentage of EGFR mRNA in LNCaP Tumor.

As highlighted in FIG. 54, it was demonstrated biological activity with the A-X-B—Y-C conjugate with a range of different antibodies and siRNA cargos that are capable of in vivo biological activity in a range of different tissue targets. In this example it was demonstrated that the DAR1 conjugate is able to achieve greater siRNA tumor concentrations, relative to the DAR 2 and unconjugated siRNA. In addition, the DAR1 conjugate is able to achieve greater levels of siRNA mediate knockdown of EGFR, relative to the DAR 2 and unconjugated siRNA.

Example 22: 2016-PK-258-WT siRNA Design and Synthesis

HPRT: A 21mer duplex with 19 bases of complementarity and 3' dinucleotide overhangs was designed against human HPRT. The sequence of the guide/antisense strand was AUAAAAUCUACAGUCAUAGUU (SEQ ID NO: 2102) and design to be complementary to the gene sequence starting a base position 425 for the human mRNA transcript for HPRT. Base, sugar and phosphate modifications were used to optimize the potency of the duplex and reduce immunogenicity. All siRNA single strands were fully assembled on solid phase using standard phosphoramidite chemistry and purified over HPLC. Purified single strands were duplexed to get the double stranded siRNA. The passenger strand contained two conjugation handles, a C6-NH2 at the 5' end and a C6-SH at the 3' end. Both conjugation handles were connected to siRNA passenger strand via phosphodiester-inverted abasic-phosphorothioate linker. The C6-NH2 and C6-SH were connected through the phosphodiester, see Example 9 for the chemical structure.

Negative control siRNA sequence (scramble): A published (Burke et al. (2014) Pharm. Res., 31(12):3445-60) 21mer duplex with 19 bases of complementarity and 3' dinucleotide overhangs was used. The sequence (5' to 3') of the guide/antisense strand was UAUCGACGUGUCCAGC-UAGUU (SEQ ID NO: 2116). The same base, sugar and phosphate modifications that were used for the active EGFR siRNA duplex were used in the negative control siRNA. All siRNA single strands were fully assembled on solid phase using standard phospharamidite chemistry and purified over HPLC. Purified single strands were duplexed to get the double stranded siRNA. The passenger strand contained two conjugation handles, a C6-NH2 at the 5' end and a C6-SH at the 3' end. Both conjugation handles were connected to siRNA passenger strand via a phosphodiester-inverted abasic-phosphodiester linker, see Example 9 for the chemical structure.

ASC Synthesis and Characterization

Conjugates in groups 1-3 and 7-9 were made and purified as a DAR1 (n=1) using ASC architecture-4, as described in Example 9. Conjugates in groups 4-6 were made and purified as a DAR1 (n=1) using ASC architecture-1, as described in Example 9.

In Vivo Study Design

Groups (n=4) of wild-type female CD-1 mice were treated with one intravenous (i.v.) tail vein injections of siRNA conjugates, while the control group (n=4) of the same mice received one i.v. injection of PBS as a vehicle control. Table 34 illustrates the study design in more detail. 50 mg pieces of tissue, were collected and snap-frozen in liquid nitrogen. mRNA knockdown in target tissue was determined using a comparative qPCR assay as described in Example 2. Total RNA was extracted from the tissue, reverse transcribed and mRNA levels were quantified using TaqMan qPCR, using the appropriately designed primers and probes. PPIB (housekeeping gene) was used as an internal RNA loading control, results were calculated by the comparative Ct method, where the difference between the target gene Ct value and the PPIB Ct value (ΔCt) is calculated and then further normalized relative to the PBS control group by taking a second difference (ΔΔCt). Quantitation of tissue siRNA concentrations were determined using a stem-loop qPCR assay as described in Example 2. The antisense strand of the siRNA was reverse transcribed using a TaqMan MicroRNA reverse transcription kit using a sequence-specific stem-loop RT primer. The cDNA from the RT step was then utilized for real-time PCR and Ct values were transformed into plasma or tissue concentrations using the linear equations derived from the standard curves.

TABLE 34

| Group | Test Article | N | SiRNA Dose (mg/kg) | ROA | Dose Volume (mL/kg) | # of Doses | Harvest Time (h) |
|---|---|---|---|---|---|---|---|
| 1 | Anti-B cell Ab(Cys)-HPRT-PEG5k (n = 1) | 4 | 3 | IV | 5.0 | 1 | 96 |
| 2 | Anti-B cell Ab(Cys)-HPRT-PEG5k (n = 1) | 4 | 1 | IV | 5.0 | 1 | 96 |
| 3 | Anti-B cell Ab(Cys)-HPRT-PEG5k (n = 1) | 4 | 0.3 | IV | 5.0 | 1 | 96 |
| 4 | Anti-B cell Ab(Lys)-HPRT-PEG5k (n = 1) | 4 | 3 | IV | 5.0 | 1 | 96 |
| 5 | Anti-B cell Ab(Lys)-HPRT-PEG5k (n = 1) | 4 | 1 | IV | 5.0 | 1 | 96 |
| 6 | Anti-B cell Ab(Lys)-HPRT-PEG5k (n = 1) | 4 | 0.3 | IV | 5.0 | 1 | 96 |
| 7 | Anti-B cell Ab(Cys)-scramble-PEG5k (n = 1) | 4 | 3 | IV | 5.0 | 1 | 96 |
| 8 | Anti-B cell Ab(Cys)-scramble-PEG5k (n = 1) | 4 | 1 | IV | 5.0 | 1 | 96 |
| 9 | Anti-B cell Ab(Cys)-scramble-PEG5k (n = 1) | 4 | 0.3 | IV | 5.0 | 1 | 96 |
| 10 | PBS Control | 4 | — | IV | 5.0 | 1 | 96 |
| | Total # of Animals: | 77 | | WT mice (CD-1) | | | |

Figure 64A:
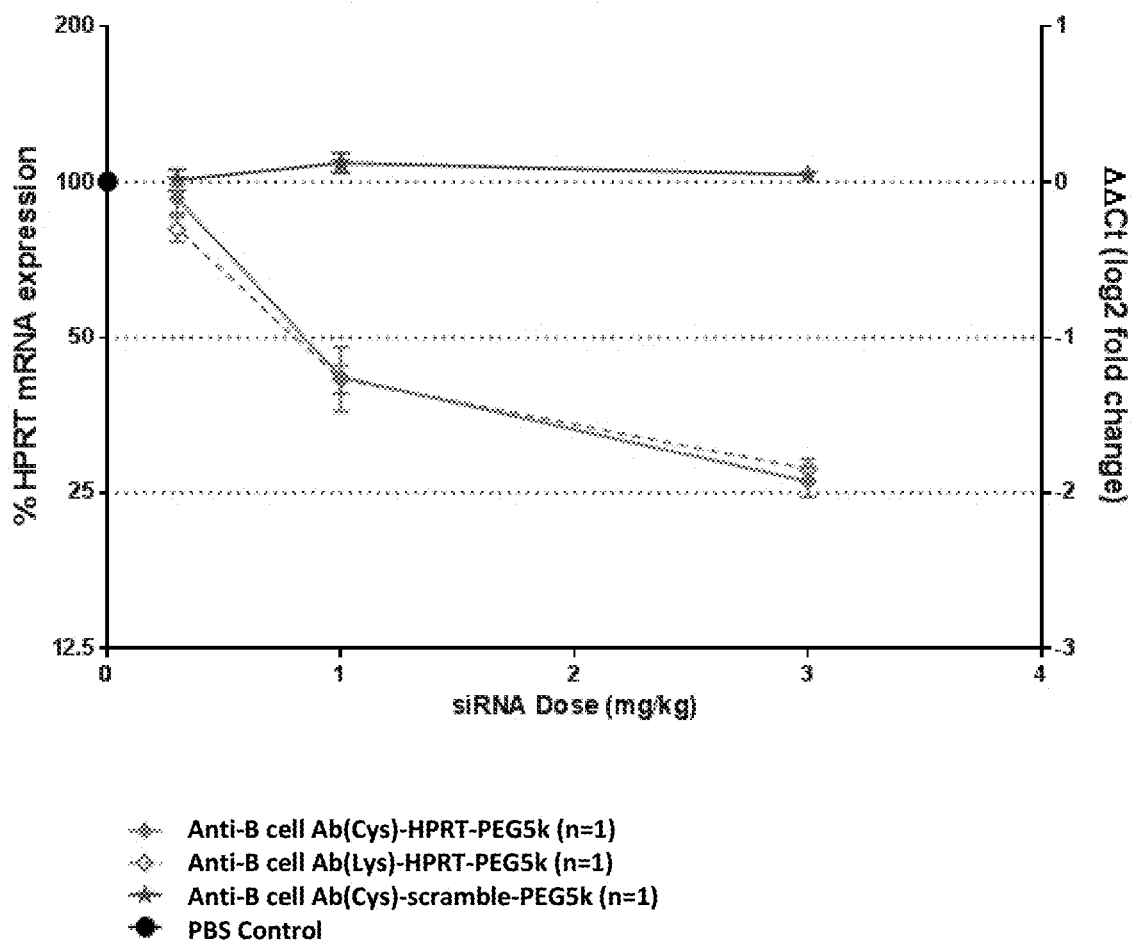
FIG. 64A-FIG. 64E illustrate HPRT mRNA expression level in heart (FIG. 64A), HPRT mRNA expression level in gastrointestinal tissue (FIG. 64B), HPRT mRNA expression level in liver (FIG. 64C), HPRT mRNA expression level in lung (FIG. 64D), and siRNA concentration in tissue (FIG. 64E) of exemplary molecules described herein.
Figure 64B:
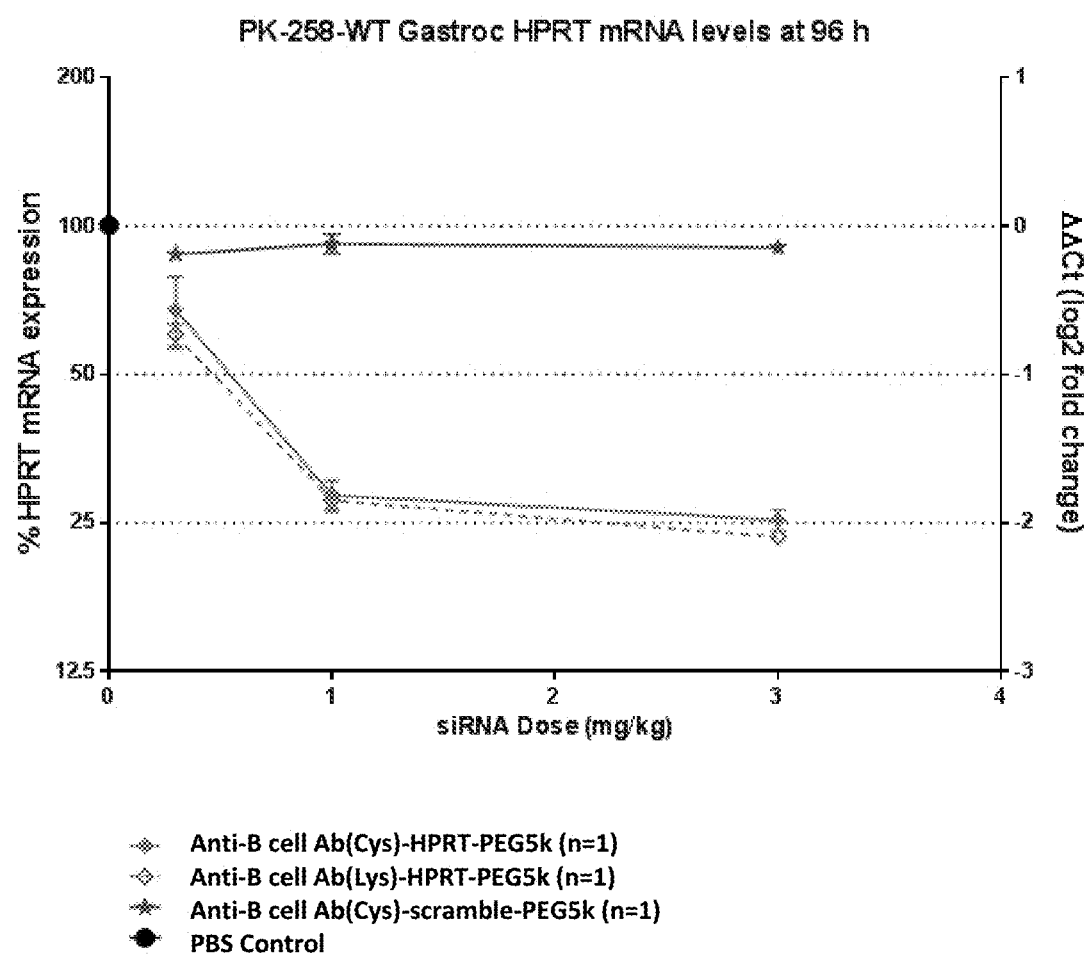
Figure 64C:
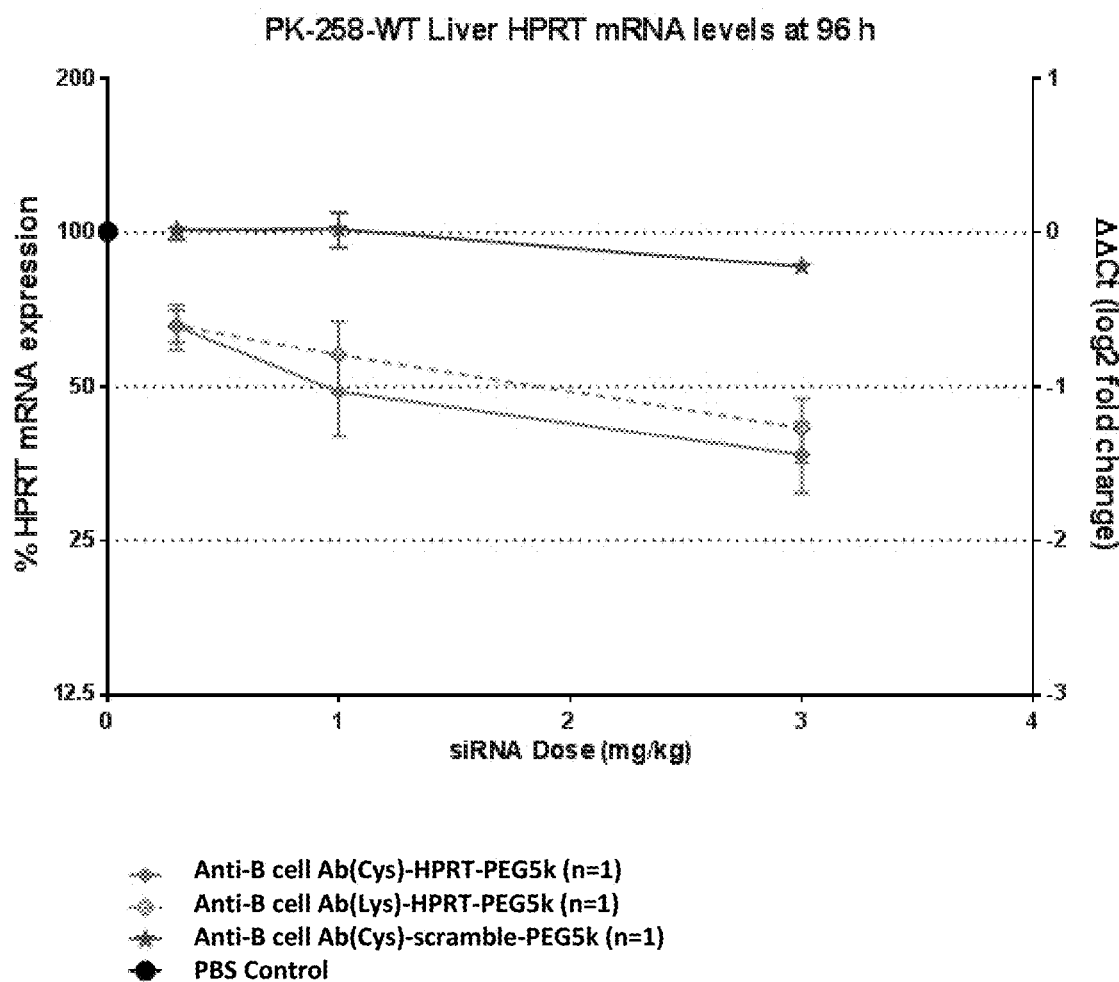
Figure 64D:
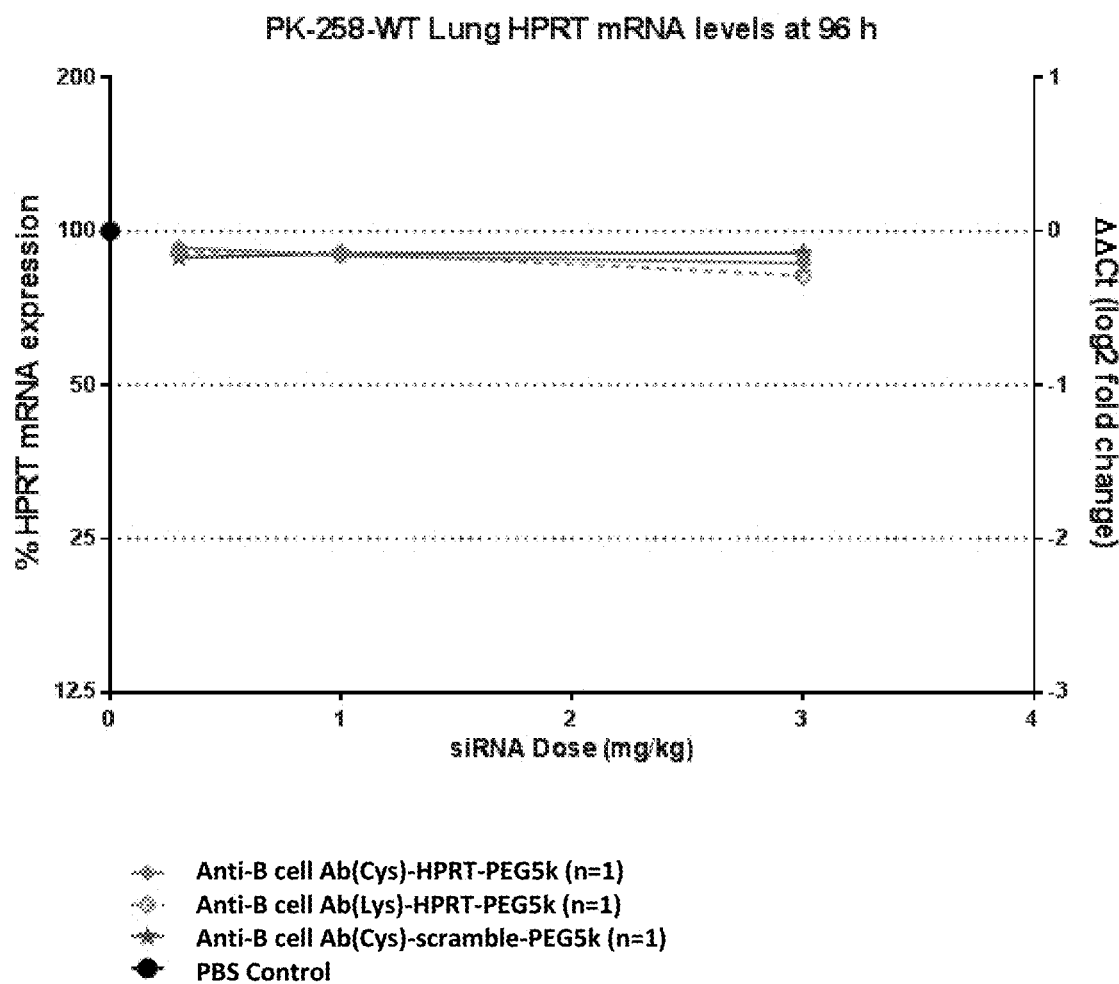
Figure 64E:
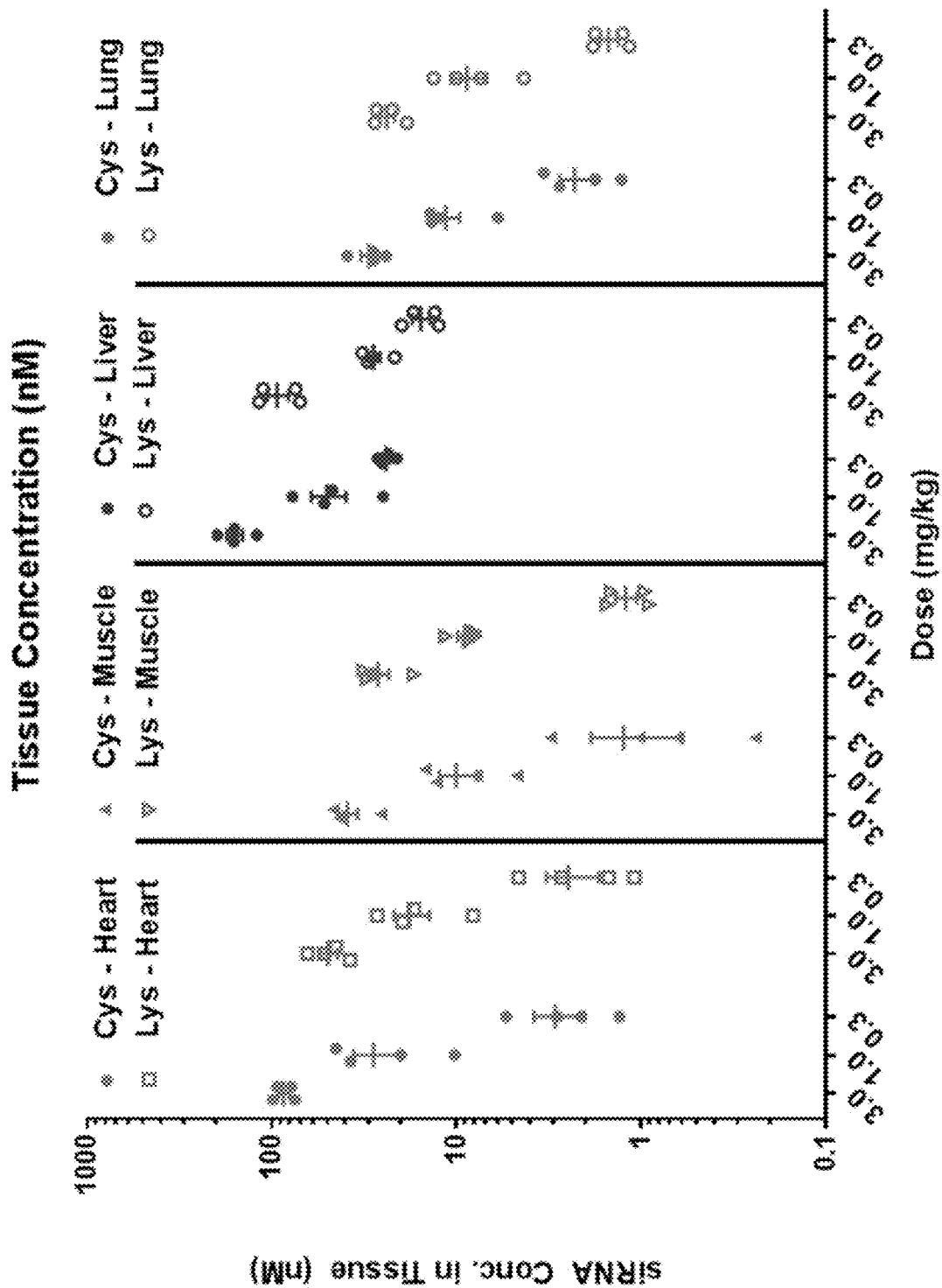

As illustrated on FIG. 64A-FIG. 64C, after a single i.v. administration of an ASC dose dependent knockdown of HPRT in heart muscle, gastroc skeletal muscle and liver were measured. There was no measurable knockdown of HPRT in the lung tissue (FIG. 64D). In addition, dose dependent accumulation of the siRNA in all four tissue compartments was observed (FIG. 64E). There was no significant difference in the biological activity (KD and tissue concentration) between the lysine and cysteine conjugates.

As highlighted in FIG. 54, it was demonstrated biological activity with the A-X-B—Y-C conjugate with a range of different antibodies and siRNA cargos that are capable of in vivo biological activity in a range of different tissue targets. In this example it was demonstrated that an anti-B cell antibody can be used to target an siRNA to heart muscle, gastroc skeletal muscle and liver and achieve gene specific downregulation of the reporter gene HPRT. There was no measurable difference in the biological activity of the ASC constructs when a lysine or cysteine conjugation strategy was use to attach to the antibody.

Example 23: 2016-PK-254-WT siRNA Design and Synthesis

HPRT: A 21mer duplex with 19 bases of complementarity and 3' dinucleotide overhangs was designed against human HPRT. The sequence of the guide/antisense strand was AUAAAAUCUACAGUCAUAGUU (SEQ ID NO: 2102) and design to be complementary to the gene sequence starting a base position 425 for the human mRNA transcript for HPRT. Base, sugar and phosphate modifications that are well described in the field of RNAi were used to optimize the potency of the duplex and reduce immunogenicity. All siRNA single strands were fully assembled on solid phase using standard phospharamidite chemistry and purified over HPLC. Purified single strands were duplexed to get the double stranded siRNA. The passenger strand contained two conjugation handles, a C6-NH2 at the 5' end and a C6-SH at the 3' end. Both conjugation handles were connected to siRNA passenger strand via phosphodiester-inverted abasic-phosphorothioate linker. The C6-NH2 and C6-SH were connected through the phosphodiester, see Example 9 for the chemical structure.

method, where the difference between the target gene Ct value and the PPIB Ct value ($\Delta$Ct) is calculated and then further normalized relative to the PBS control group by taking a second difference ($\Delta\Delta$Ct). Quantitation of tissue siRNA concentrations were determined using a stem-loop qPCR assay as described in Example 2. The antisense strand of the siRNA was reverse transcribed using a TaqMan MicroRNA reverse transcription kit using a sequence-specific stem-loop RT primer. The cDNA from the RT step was then utilized for real-time PCR and Ct values were transformed into plasma or tissue concentrations using the linear equations derived from the standard curves.

TABLE 35

| Group | Test Article | N | SiRNA Dose (mg/kg) | ROA | Dose Volume (mL/kg) | # of Doses | Harvest Time (h) |
|---|---|---|---|---|---|---|---|
| 1 | Anti-B cell Fab(Cys)-HPRT-PEG5k (n = 1) | 4 | 10 | IV | 5.1 | 1 | 96 |
| 2 | Anti-B cell Fab(Cys)-HPRT-PEG5k (n = 1) | 4 | 3 | IV | 5.1 | 1 | 96 |
| 3 | Anti-B cell Fab(Cys)-HPRT-PEG5k (n = 1) | 4 | 1 | IV | 5.1 | 1 | 96 |
| 4 | Anti-B cell Fab(Cys)-scramble-PEG5k (n = 1) | 4 | 10 | IV | 5.1 | 1 | 96 |
| 5 | Anti-B cell Fab(Cys)-scramble-PEG5k (n = 1) | 4 | 3 | IV | 5.1 | 1 | 96 |
| 6 | Anti-B cell Fab(Cys)-scramble-PEG5k (n = 1) | 4 | 1 | IV | 5.1 | 1 | 96 |
| 7 | PBS Control | 5 | — | IV | 5.1 | 1 | 96 |
| Total # of Animals: | | 29 | | WT mice (CD-1) | | | |

Negative control siRNA sequence (scramble): A published (Burke et al. (2014) Pharm. Res., 31(12):3445-60) 21mer duplex with 19 bases of complementarity and 3' dinucleotide overhangs was used. The sequence (5' to 3') of the guide/antisense strand was UAUCGACGUGUCCAGC-UAGUU (SEQ ID NO: 2116). The same base, sugar and phosphate modifications that were used for the active EGFR siRNA duplex were used in the negative control siRNA. All siRNA single strands were fully assembled on solid phase using standard phospharamidite chemistry and purified over HPLC. Purified single strands were duplexed to get the double stranded siRNA. The passenger strand contained two conjugation handles, a C6-N H2 at the 5' end and a C6-SH at the 3' end. Both conjugation handles were connected to siRNA passenger strand via a phosphodiester-inverted abasic-phosphodiester linker, see Example 9 for the chemical structure.

ASC Synthesis and Characterization

All conjugates were made and purified as a DAR1 (n=1) using ASC architecture-4, as described in Example 9.

In Vivo Study Design

Figure 65A:
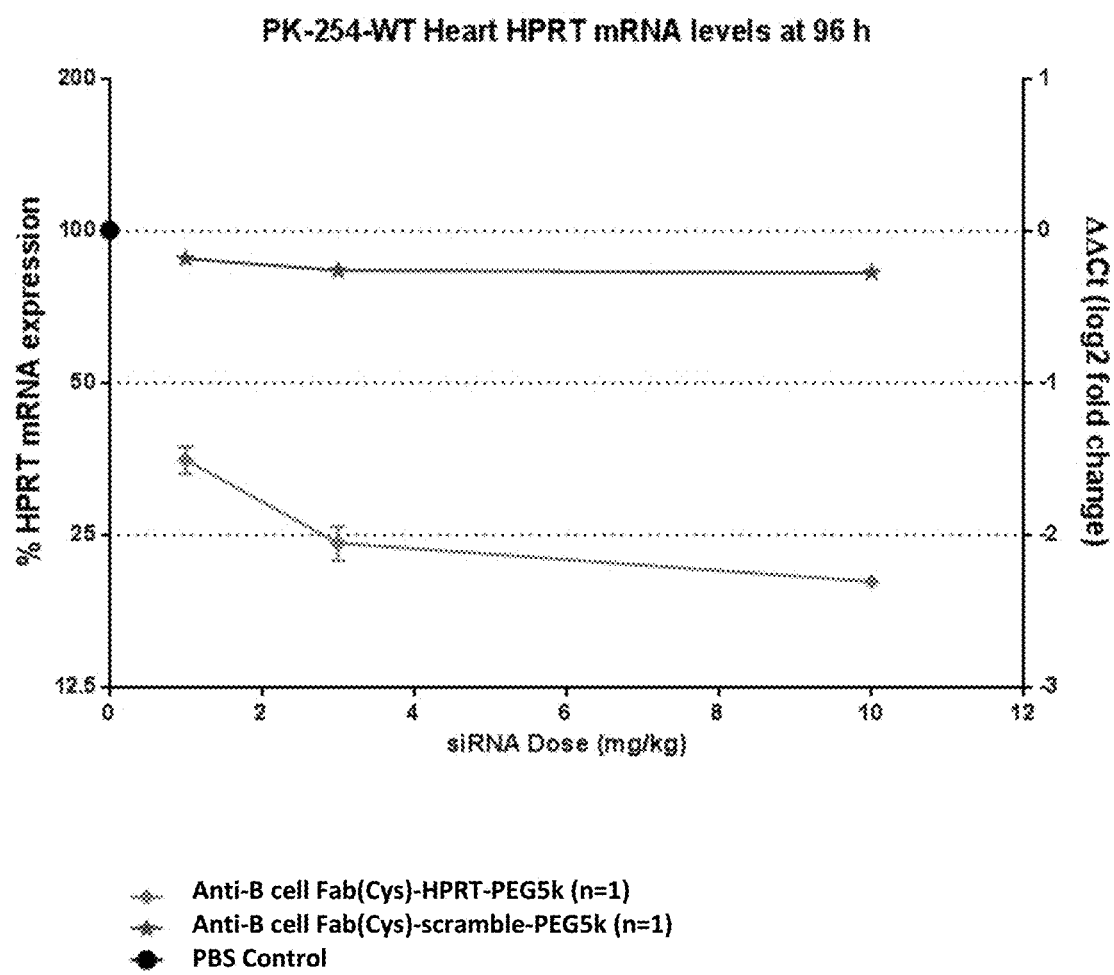
Figure 65C:
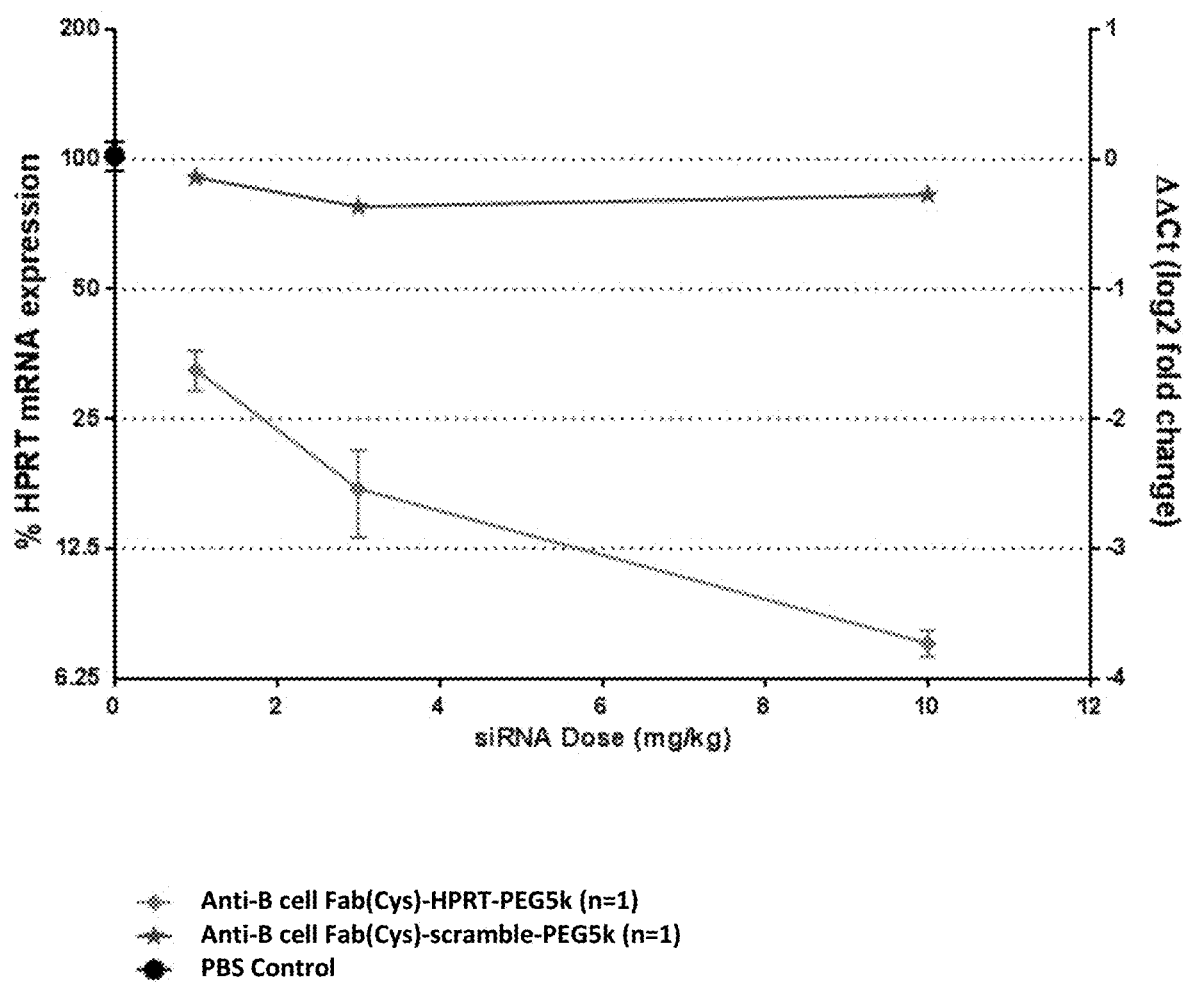
Figure 65D:
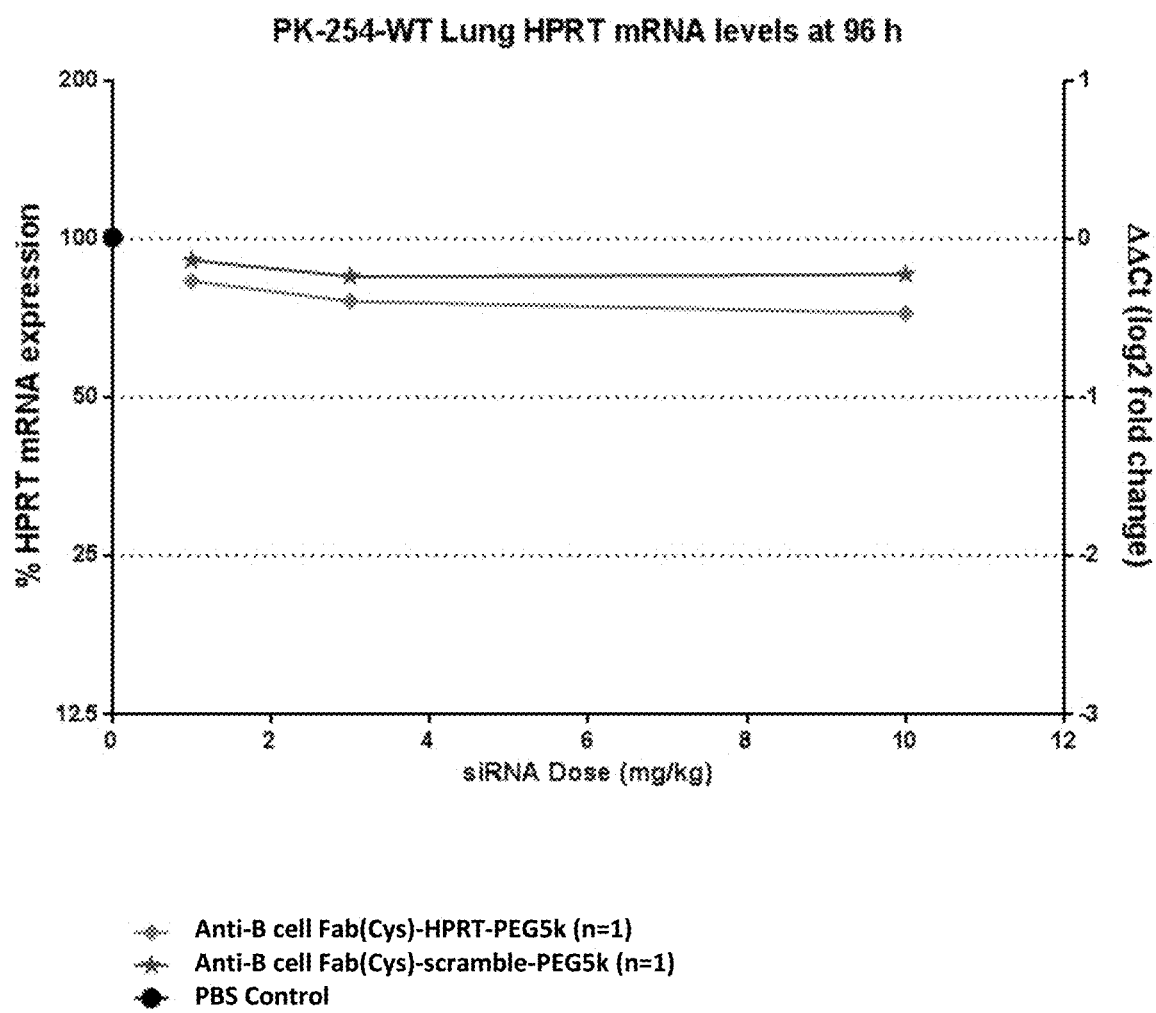
Figure 65E:
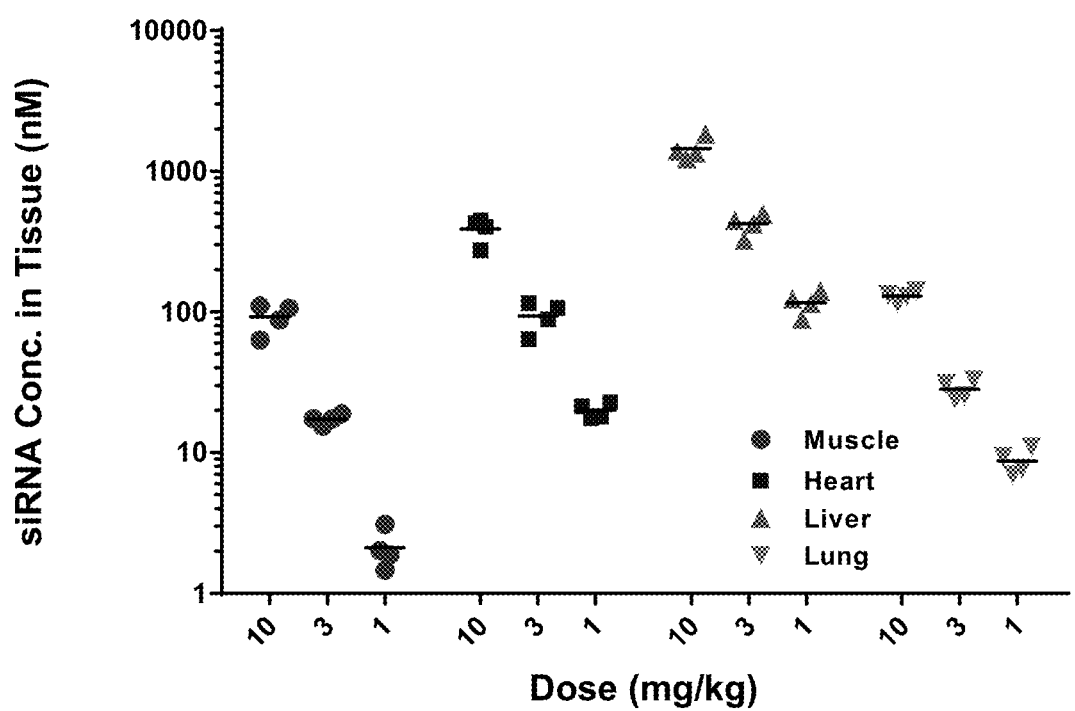

Groups (n=4) of wild-type female CD-1 mice were treated with one intravenous (i.v.) tail vein injections of siRNA conjugates, while the control group (n=5) of the same mice received one i.v. injection of PBS as a vehicle control. Table 35 illustrates the study design in more detail. 50 mg pieces of tissue, were collected and snap-frozen in liquid nitrogen. mRNA knockdown in target tissue was determined using a comparative qPCR assay as described in Example 2. Total RNA was extracted from the tissue, reverse transcribed and mRNA levels were quantified using TaqMan qPCR, using the appropriately designed primers and probes. PPIB (housekeeping gene) was used as an internal RNA loading control, results were calculated by the comparative Ct As illustrated on FIG. 65A-FIG. 65C, after a single i.v. administration of an ASC containing an anti-B cell Fab targeting ligand, dose dependent knockdown of HPRT in heart muscle, gastroc skeletal muscle and liver were measured. There was no measurable knockdown of HPRT in the lung tissue (FIG. 65D). In addition, dose dependent accumulation of the siRNA in all four tissue compartments was observed (FIG. 65E).

As highlighted in FIG. 54, biological activity was demonstrated with the A-X-B—Y-C conjugate with a range of different antibodies and siRNA cargos that are capable of in vivo biological activity in a range of different tissue targets. In this example it was demonstrated that an anti-B cell Fab is used to target an siRNA to heart muscle, gastroc skeletal muscle and liver and achieve gene specific downregulation of the reporter gene HPRT.

Example 24: 2016-PK-245-WT siRNA Design and Synthesis

CTNNB1: A 21mer duplex with 19 bases of complementarity and 3' dinucleotide overhangs was designed against human CTNNB1. The sequence of the guide/antisense strand was TUUCGAAUCAAUCCAACAGUU (SEQ ID NO: 2096), design to target the gene sequence starting a base position 1797 for the human mRNA transcript for CTNNB1. Base, sugar and phosphate modifications were used to optimize the potency of the duplex and reduce immunogenicity. All siRNA single strands were fully assembled on solid phase using standard phospharamidite chemistry and purified over HPLC. Purified single strands were duplexed to get the double stranded siRNA. The passenger strand contained two conjugation handles, a C6-NH2 at the 5' end and a C6-SH at the 3' end. Both conjugation handles were connected to siRNA passenger strand via phosphodiester-inverted abasic-phosphorothioate linker. The C6-NH2 and C6-SH were connected through the phosphodiester, see Example 9 for the chemical structure.

ASC Synthesis and Characterization

Conjugates in groups 3-4 were made and purified as a DAR1 (n=1) using ASC architecture-4, as described in Example 9. Conjugates in groups 1-2 were made and purified as a DAR1 (n=1) using ASC architecture-1, as described in Example 9.

In Vivo Study Design

Groups (n=4) of wild-type female CD-1 mice were treated with one intravenous (i.v.) tail vein injections of siRNA conjugates, while the control group (n=5) of the same mice received one i.v. injection of PBS as a vehicle control. Table 36 illustrates the study design in more detail. 50 mg pieces of tissue, were collected and snap-frozen in liquid nitrogen. mRNA knockdown in target tissue was determined using a comparative qPCR assay as described in Example 2. Total RNA was extracted from the tissue, reverse transcribed and mRNA levels were quantified using TaqMan qPCR, using the appropriately designed primers and probes. PPIB (housekeeping gene) was used as an internal RNA loading control, results were calculated by the comparative Ct method, where the difference between the target gene Ct value and the PPIB Ct value ($\Delta$Ct) is calculated and then further normalized relative to the PBS control group by taking a second difference ($\Delta\Delta$Ct). Quantitation of tissue siRNA concentrations were determined using a stem-loop qPCR assay as described in Example 2. The antisense strand of the siRNA was reverse transcribed using a TaqMan MicroRNA reverse transcription kit using a sequence-specific stem-loop RT primer. The cDNA from the RT step was then utilized for real-time PCR and Ct values were transformed into plasma or tissue concentrations using the linear equations derived from the standard curves.

In this example, it was demonstrated that an anti-B cell antibody is used to target an siRNA to heart muscle and gastroc skeletal muscle and achieve gene specific downregulation of CTNNB1 mRNA.

Example 25: 2016-PK-160-LNCaP siRNA Design and Synthesis

AR: A 21mer duplex with 19 bases of complementarity and 3' dinucleotide overhangs was designed against human AR. The sequence of the guide/antisense strand was complementary to the gene sequence starting a base position 2822 for the human mRNA transcript for AR (Guide strand sequence: GAGAGCUCCAUAGUGACACUU; SEQ ID NO: 2108). Base, sugar and phosphate modifications were used to optimize the potency of the duplex and reduce immunogenicity. All siRNA single strands were fully assembled on solid phase using standard phospharamidite chemistry and purified over HPLC. Purified single strands were duplexed to get the double stranded siRNA. The passenger strand contained two conjugation handles, a C6-NH2 at the 5' end and a C6-SH at the 3' end. Both conjugation handles were connected to siRNA passenger strand via phosphorothioate-inverted abasic-phosphorothioate linker, see Example 9 for the chemical structure.

Negative control siRNA sequence (scramble): A published (Burke et al. (2014) Pharm. Res., 31(12):3445-60) 21mer duplex with 19 bases of complementarity and 3' dinucleotide overhangs was used. The sequence (5' to 3') of the guide/antisense strand was UAUCGACGUGUCCAGC-UAGUU (SEQ ID NO: 2116). Base, sugar and phosphate modifications were used to reduce immunogenicity and were comparable to those used in the active siRNA. All siRNA single strands were fully assembled on solid phase using standard phospharamidite chemistry and purified over

TABLE 36

| Group | Test Article | N | SiRNA Dose (mg/kg) | ROA | Dose Volume (mL/kg) | # of Doses | Harvest Time (h) |
|---|---|---|---|---|---|---|---|
| 1 | Anti-B cell Ab(Lys)-CTNNB1-PEG5k (n = 1) | 4 | 3 | IV | 5.0 | 1 | 96 |
| 2 | Anti-B cell Ab(Lys)-CTNNB1-PEG5k (n = 1) | 4 | 1 | IV | 5.0 | 1 | 96 |
| 3 | Anti-B cell Ab(Cys)-CTNNB1-PEG5k (n = 1) | 4 | 3 | IV | 5.0 | 1 | 96 |
| 4 | Anti-B cell Ab(Cys)-CTNNB1-PEG5k (n = 1) | 4 | 1 | IV | 5.0 | 1 | 96 |
| 5 | PBS Control | 5 | — | IV | 5.0 | 1 | 96 |
| | Total # of Animals: | 21 | | WT mice (CD-1) | | | |

Figure 66A:
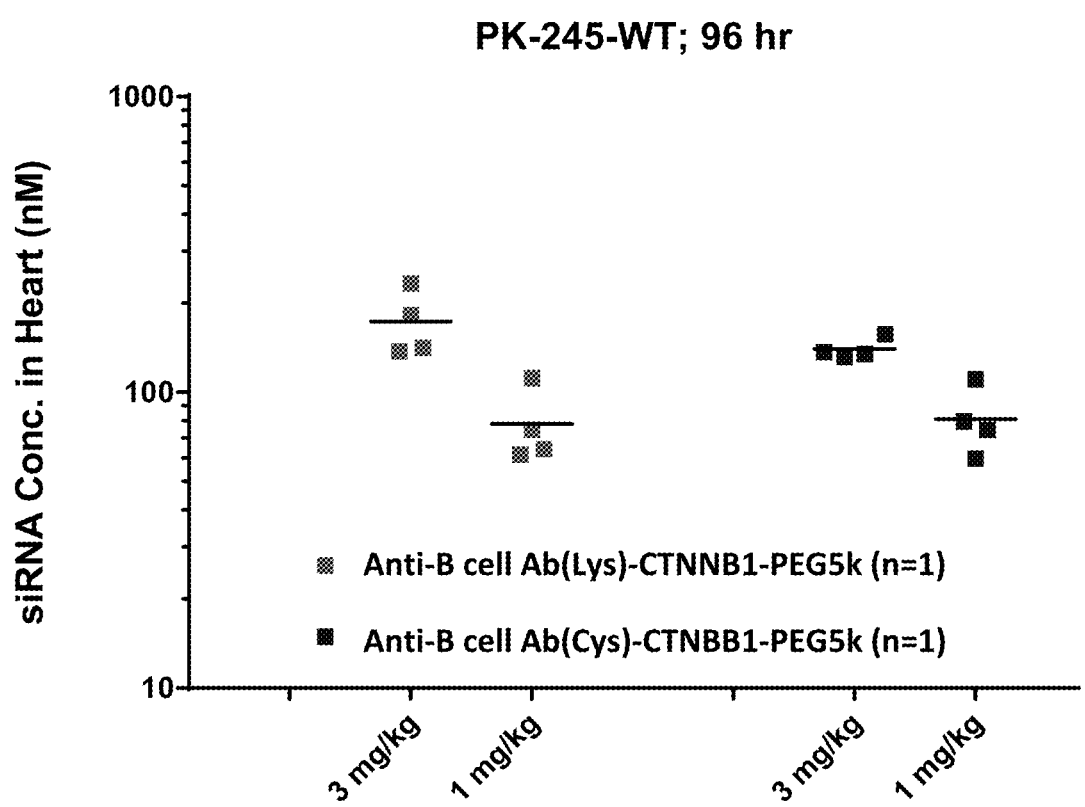
Figure 66B:
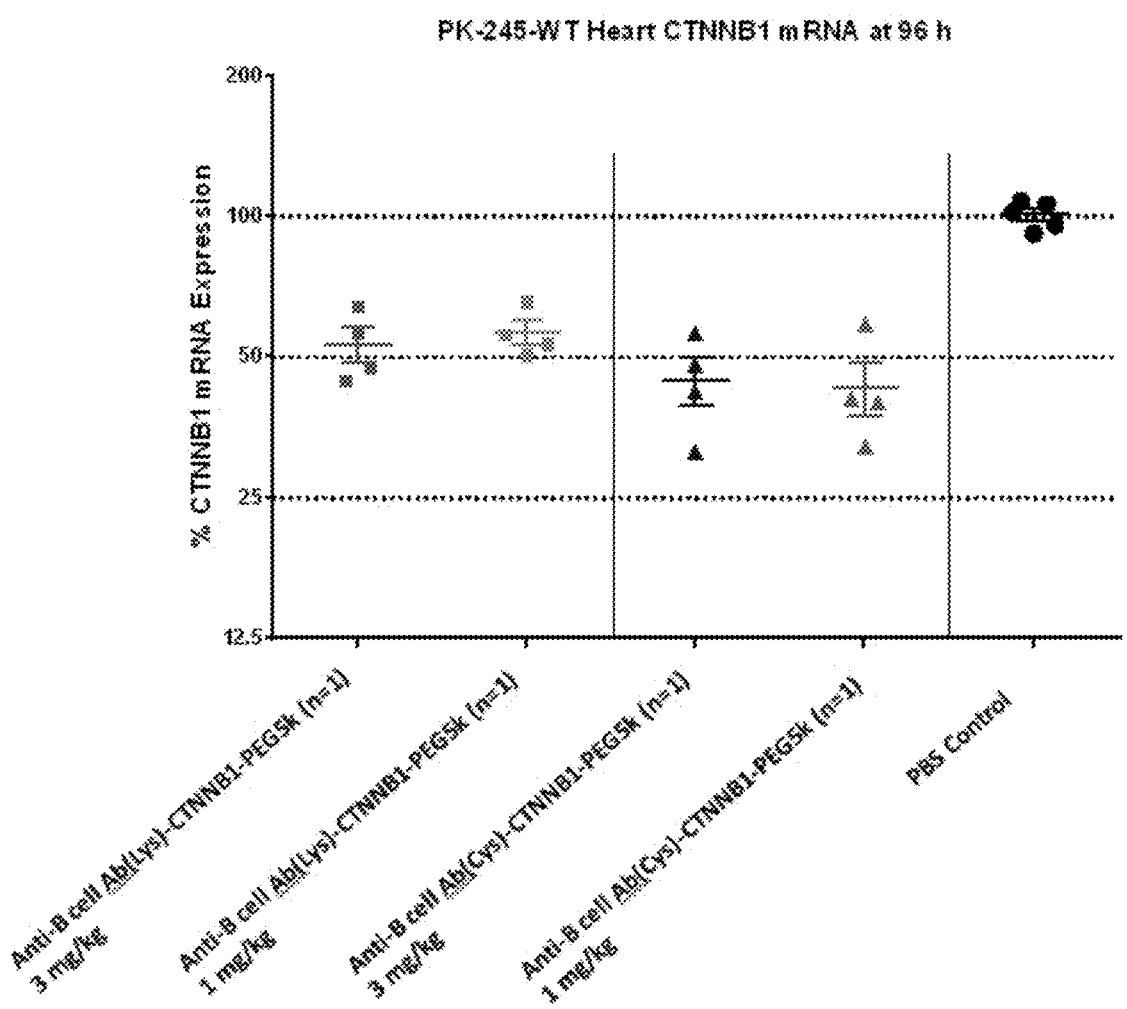
Figure 66C:
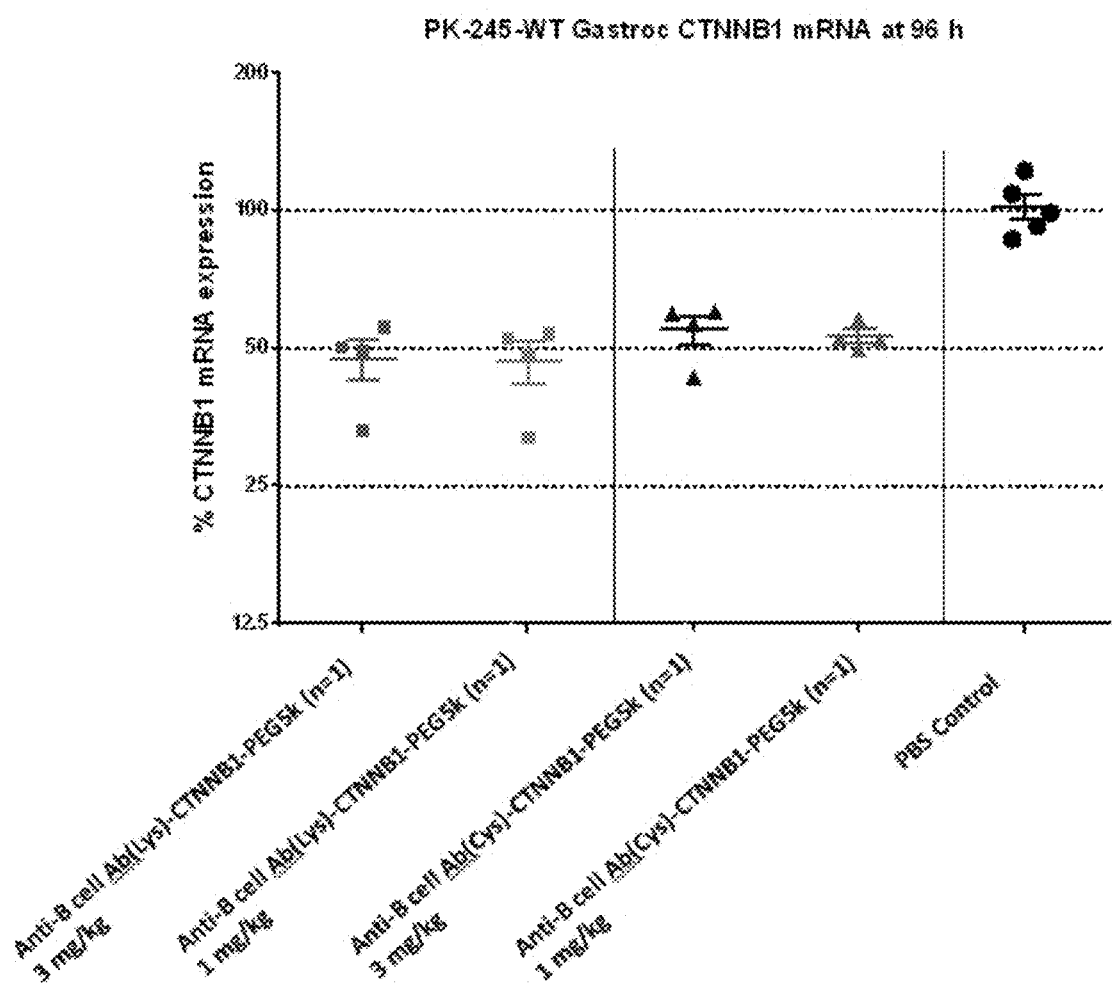

As illustrated on FIG. 66A and FIG. 66B, after a single i.v. administration of an ASC containing an anti-B cell antibody targeting ligand (anti-B cell-Ab), HPRT knockdown and dose dependent tissue siRNA accumulation in heart muscle were elicited. As illustrated on FIG. 66C and FIG. 66D, after a single i.v. administration of an ASC containing an anti-B cell antibody targeting ligand, HPRT knockdown and dose dependent tissue siRNA accumulation in gastroc skeletal muscle were elicited. There was no significant difference in the biological activity (KD and tissue concentration) between the lysine and cysteine conjugates.

As highlighted in FIG. 54, it was demonstrated biological activity with the A-X-B—Y-C conjugate with a range of different antibodies and siRNA cargos that are capable of in vivo biological activity in a range of different tissue targets.

HPLC. Purified single strands were duplexed to get the double stranded siRNA. The passenger strand contained two conjugation handles, a C6-NH2 at the 5' end and a C6-SH at the 3' end. Both conjugation handles were connected to siRNA passenger strand via a phosphodiester-inverted abasic-phosphodiester linker, see Example 9 for the chemical structure.

ASC Synthesis and Characterization

All conjugates were made and purified as a DAR1 (n=1) using ASC architecture-1, as described in Example 9.

In Vivo Study Design

Groups (n=5) of female SCID SHO mice bearing subcutaneous flank LNCaP tumors 100-350 mm³ in volume were treated with one intravenous (i.v.) tail vein injection of siRNA conjugate, while control group (n=5) of the same mice received one i.v. injection of PBS as a vehicle control. The table below describes the study design. Mice were sacrificed by $CO_2$ asphyxiation at 96 hours post-dose. 50 mg pieces of tumor and liver, were collected and snap-frozen in liquid nitrogen. mRNA knockdown in target tissue was determined using a comparative qPCR assay as described in Example 2. Total RNA was extracted from the tissue, reverse transcribed and mRNA levels were quantified using TaqMan qPCR, using the appropriately designed primers and probes. PPIB (housekeeping gene) was used as an internal RNA loading control, results were calculated by the comparative Ct method, where the difference between the target gene Ct value and the PPIB Ct value ($\Delta$Ct) is calculated and then further normalized relative to the PBS control group by taking a second difference ($\Delta\Delta$Ct). Quantitation of tissue siRNA concentrations were determined using a stem-loop qPCR assay as described in Example 2. The antisense strand of the siRNA was reverse transcribed using a TaqMan MicroRNA reverse transcription kit using a sequence-specific stem-loop RT primer. The cDNA from the RT step was then utilized for real-time PCR and Ct values were transformed into plasma or tissue concentrations using the linear equations derived from the standard curves.

and design to be complementary to the gene sequence starting a base position 425 for the human mRNA transcript for HPRT. Base, sugar and phosphate modifications were used to optimize the potency of the duplex and reduce immunogenicity. All siRNA single strands were fully assembled on solid phase using standard phosphoramidite chemistry and purified over HPLC. Purified single strands were duplexed to get the double stranded siRNA. The passenger strand contained two conjugation handles, a C6-NH2 at the 5' end and a C6-SH at the 3' end. Both conjugation handles were connected to siRNA passenger strand via phosphodiester-inverted abasic-phosphorothioate linker. The C6-NH2 and C6-SH were connected through the phosphodiester, see Example 9 for the chemical structure.

ASC Synthesis and Characterization

All conjugates were made and purified as a DAR1 (n=1) using ASC architecture-4, as described in Example 9.

In Vitro Study Design

Mouse spleens were harvested and kept in PBS with 100 u/ml penicillin and streptomycin on ice. Spleens were smashed with clean glass slides, cut into small pieces, homogenized with 18G needles, and filtered (70 urn nylon membrane). Dead cells were removed with the dead cell removal kit from Milteny biotec (Catalog#130-090101)

TABLE 37

| Group | Test Article | N | SiRNA Dose (mg/kg) | ROA | Dose Volume (mL/kg) | # of Doses | Harvest Time (h) |
|---|---|---|---|---|---|---|---|
| 1 | ANT4044(Lys)-AR-PEG5k (n = 1) | 5 | 1 | IV | 5.0 | 1 | 96 |
| 2 | ANT4044(Lys)-AR-PEG5k (n = 1) | 5 | 0.5 | IV | 5.0 | 1 | 96 |
| 3 | ANT4044(Lys)-AR-PE5k (n = 1) | 5 | 0.25 | IV | 5.0 | 1 | 96 |
| 4 | ANT4044(Lys)-scramble-PEG5k (n = 1) | 5 | 1 | IV | 5.0 | 1 | 96 |
| 5 | PBS Control | 5 | — | IV | 5.0 | 1 | 96 |
| | Total # of Animals: | 30 | | castrated SCID SHO mice with LNCaP tumors | | | |

Figure 67A:
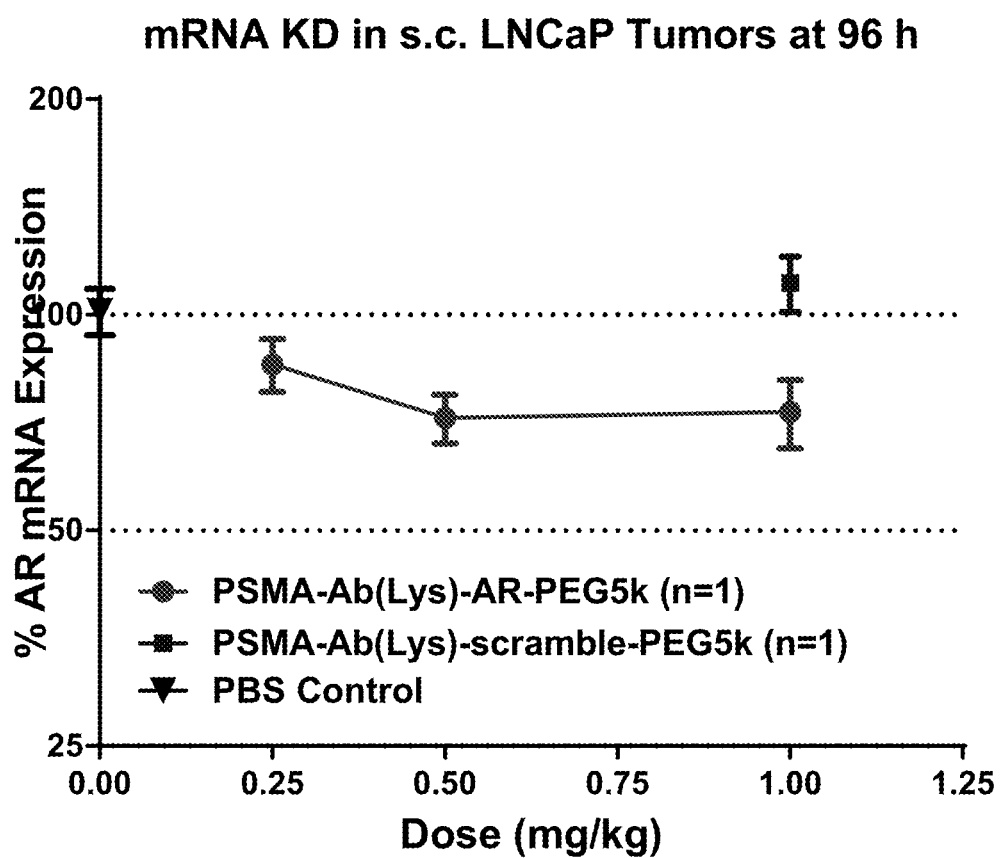
FIG. 67A illustrate mRNA expression level of exemplary molecules described herein.
Figure 67B:
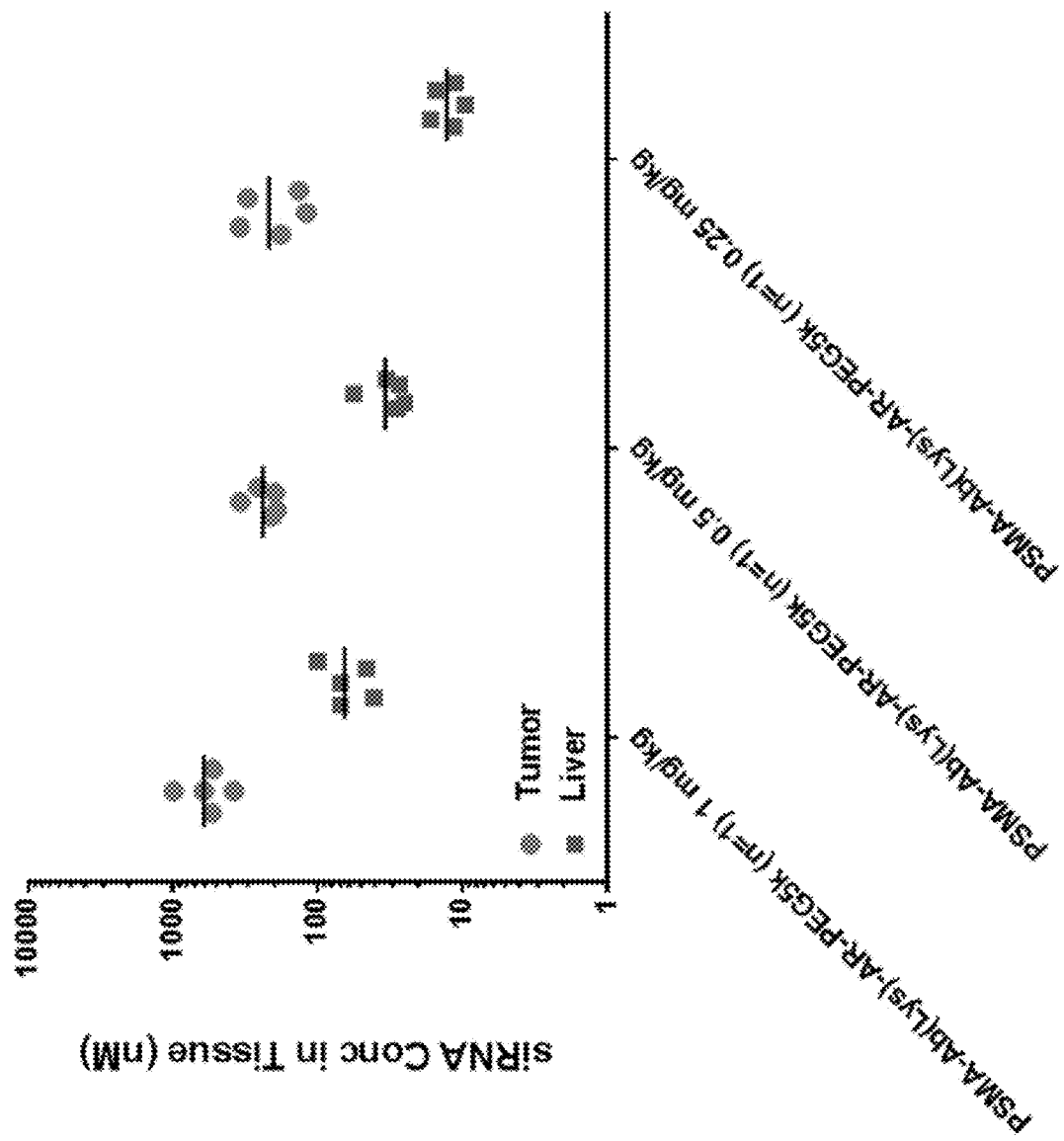
FIG. 67B shows siRNA concentration of exemplary molecules described herein in tumor or liver tissues.

As illustrated in FIG. 67A, after a single i.v. administration of an ASC containing a PSMA antibody targeting ligand and siRNA designed to downregulate AR, AR knockdown in the LNCaP tumor tissue at all the doses tested relative to the scrambled control was elicited. As illustrated FIG. 67B, there was measurable accumulation of siRNA in the tumor tissue and at levels higher than those measured in the liver tissue.

As highlighted in FIG. 54, it was demonstrated biological activity with the A-X-B—Y-C conjugate with a range of different antibodies and siRNA cargos that are capable of in vivo biological activity in a range of different tissue targets. In this example, it was demonstrated delivery to an LNCaP prostate tumor with a PSMA antibody conjugated to an siRNA designed to down regulate AR mRNA. LNCaP cells express human PSMA on cell surface, the conjugate has a human specific PSMA antibody that binds to the antigen and allows internalization of the siRNA, resulting in siRNA mediated knockdown of AR in the tumortissue.

Example 26: In Vitro Uptake and Knockdown in B Cells siRNA Design and Synthesis HPRT: A 21mer duplex with 19 bases of complementarity and 3' dinucleotide overhangs was designed against human HPRT. The sequence of the guide/antisense strand was AUAAAAUCUACAGUCAUAGUU (SEQ ID NO: 2102)

according to manufacturer instruction. To isolate mouse B cells, B cell isolation kit Milteny biotec (Catalog#130-090-862) was used following manufacturer instruction. Briefly, live spleen cells were resuspended with 200 µl of MACS buffer per mouse spleen. Non-B cells were depleted with biotin-conjugated monoclonal antibodies against CD43 (Ly48), CD4, and Ter-119, coupled with anti-biotin magnetic microbeads. From one mouse spleen, 30 million live B cells can be obtained. To activate isolated mouse B cells ($2\times10^6$/ml in 10% FBS RPMI-1640 with 100 u/ml penicillin and streptomycin), a cocktail of 10 µg/ml LPS, 5 µg/ml anti-IgM, 1 µg/ml anti-CD40, 0.05 µg/ml IL-4, and 0.05 µg/ml INFγ was added. After four hours of activation, ASCs (1 pM to 10 nM) were added to $10^6$ cells per well in 24 (0.5 ml media) or 12 (1 ml media) well plates. After 48 hours of ASC treatments, cells were harvested and isolated RNAs were analyzed for mRNA knockdown.

TABLE 38

| Group | Test Article |
|---|---|
| 1 | Anti-B cell Ab(Cys)-HPRT-PEG5k (n = 1) |
| 2 | Anti-B cell Ab (Cys)-scramble-PEG5k (n = 1) |
| 3 | Anti-B cell Fab(Cys)-HPRT-PEG5k (n = 1) |
| 4 | Anti-B cell Fab(Cys)-scramble-PEG5k (n = 1) |
| 5 | Anti-B cell Ab |
| 6 | Vehicle Control |

Figure 68A:
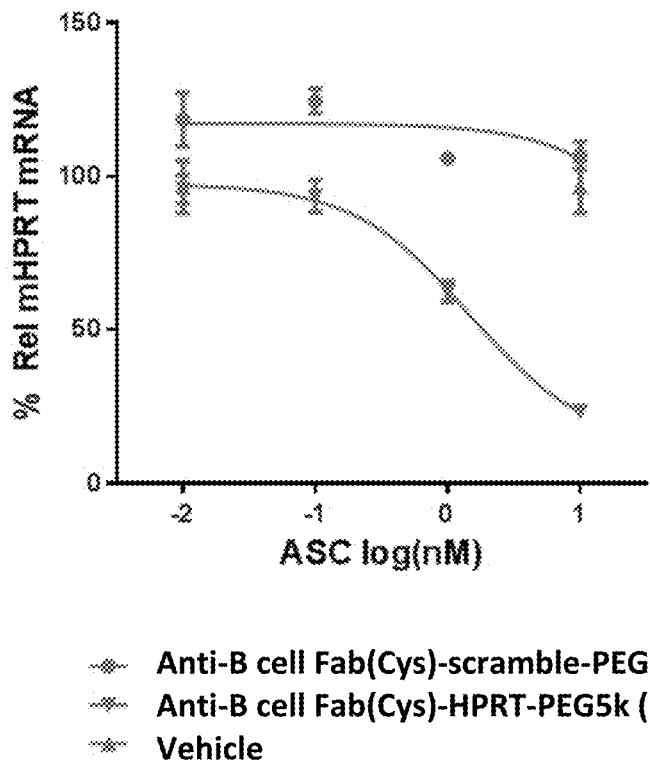
FIG. 68A-FIG. 68B illustrate anti-B cell antibody-siRNA conjugates which activate primary mouse B cells.
Figure 68B:
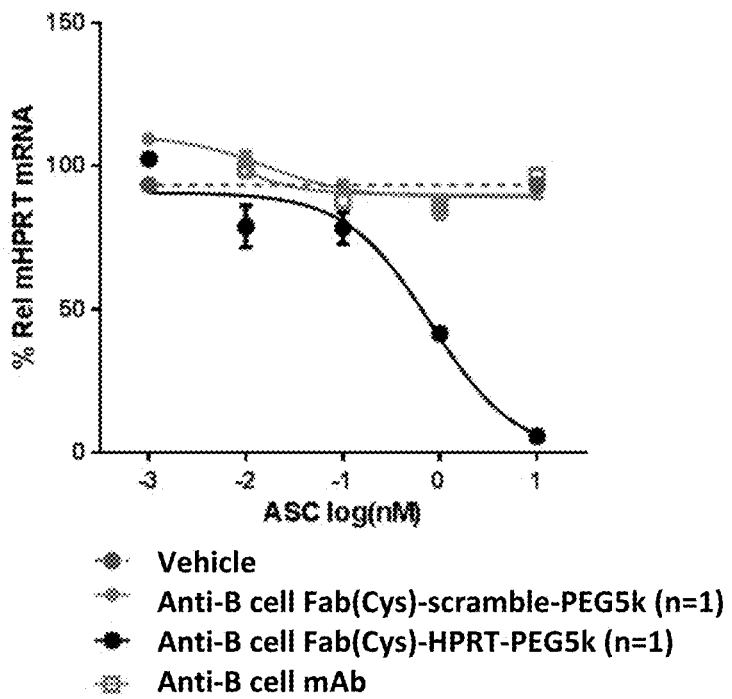

In this in vitro experiment in activated primary mouse B cells, the ability of an anti-B cell antibody and Fab ASCs to deliver an siRNA design to downregulate Hypoxanthine-guanine phosphoribosyltransferase (HPRT) was measured. As illustrated in FIG. 68A, the Fab conjugate was able to downregulate HPRT relative to the vehicle or scramble controls. As illustrated in FIG. 68B, the antibody conjugate was able to downregulate HPRT relative to the antibody, vehicle, and scramble controls.

As highlighted in FIG. 54, it was demonstrated biological activity with the A-X-B—Y-C conjugate with a range of different antibodies and siRNA cargos that are capable of in vivo biological activity in a range of different tissue targets. In this example, it was demonstrated delivery to an activated mouse B cell with a mouse anti-B cell antibody or anti-B cell Fab conjugated to an siRNA designed to down regulate HPRT mRNA. Activated mouse B cells recognize and internalize the antibody-siRNA conjugate via surface receptors that recognize the anti-B cell antibody, resulting in siRNA mediated knockdown of HPRT.

Example 27: 2016-PK-249-WT siRNA Design and Synthesis

EFGR: A 21mer duplex with 19 bases of complementarity and 3' dinucleotide overhangs was designed against human EGFR. The sequence of the guide/antisense strand was complementary to the gene sequence starting a base position 333 for the human mRNA transcript for EGFR (ACUCGUGCCUUGGCAAACUUU; SEQ ID NO: 2082). Base, sugar and phosphate modifications were used to optimize the potency of the duplex and reduce immunogenicity. All siRNA single strands were fully assembled on solid phase using standard phosphoramidite chemistry and purified over HPLC. Purified single strands were duplexed to get the double stranded siRNA. The passenger strand contained two conjugation handles, a C6-NH2 at the 5' end and a C6-SH at the 3' end. Both conjugation handles were connected to siRNA passenger strand via phosphorothioate-inverted abasic-phosphorothioate linker, see Example 9 for the chemical structure.

KRAS: A 21mer duplex with 19 bases of complementarity and 3' dinucleotide overhangs was designed against human EGFR. The sequence of the guide/antisense strand was complementary to the gene sequence starting a base position 237 for the human mRNA transcript for KRAS (UGAAUUAGCUGUAUCGUCAUU; SEQ ID NO: 2088). Base, sugar and phosphate modifications were used to optimize the potency of the duplex and reduce immunogenicity. All siRNA single strands were fully assembled on solid phase using standard phosphoramidite chemistry and purified over HPLC. Purified single strands were duplexed to get the double stranded siRNA. The passenger strand contained two conjugation handles, a C6-NH2 at the 5' end and a C6-SH at the 3' end. Both conjugation handles were connected to siRNA passenger strand via phosphorothioate-inverted abasic-phosphorothioate linker, see Example 9 for the chemical structure.

ASC Synthesis and Characterization

The conjugate for groups 1-2 were made and purified as a DAR1 (n=1) using ASC architecture-4, as described in Example 9. The conjugate for groups 3-4 were made and purified as a DAR2 (n=2) using ASC architecture-4, as described in Example 9. The conjugate for groups 5-6 were made and purified as a DAR1 (n=1) using ASC architecture-5, as described in Example 9. The conjugate for groups 7-8 were made and purified as a DAR2 (n=2) using ASC architecture-5, as described in Example 9. The conjugate for groups 9-10 were made and purified as a DAR1 (n=1) using ASC architecture-6, as described in Example 9. The conjugate for groups 11-12 were made and purified as a DAR2 (n=2) using ASC architecture-6, as described in Example 9.

In Vivo Study Design

Groups (n=4) of wild-type female CD-1 mice were treated with one intravenous (i.v.) tail vein injections of siRNA conjugates (groups 1-12) or antibody alone (groups 13-14). Table 39 illustrates the study design. Non-terminal blood samples were collected at 0.25, and 3 hours post-dose via puncture of the retro-orbital plexus and centrifuged to generate plasma for PK analysis. Mice were sacrificed by $CO_2$ asphyxiation at 24 and 72 hours post-dose. Terminal blood samples were collected via cardiac puncture and processed to generate plasma for PK analysis. Quantitation of plasma siRNA concentrations were determined using a stem-loop qPCR assay as described in Example 2. The antisense strand of the siRNA was reverse transcribed using a TaqMan MicroRNA reverse transcription kit using a sequence-specific stem-loop RT primer. The cDNA from the RT step was then utilized for real-time PCR and Ct values were transformed into plasma or tissue concentrations using the linear equations derived from the standard curves. Plasma concentrations of antibody were determined using an ELISA assay.

TABLE 39

| Gr | Test Article | N | siRNA Dose (mg/kg) | Dose Volume (mL/kg) | # of Doses | Survival Bleed (h) | Terminal Bleed (h) |
|---|---|---|---|---|---|---|---|
| 1 | EGFR-Ab(Cys)-EGFR-PEG5k (n = 1) | 4 | 0.5 | 5.0 | 1 | 0.25 | 24 |
| 2 | EGFR-Ab(Cys)-EGFR-PEG5k (n = 1) | 4 | 0.5 | 5.0 | 1 | 3 | 72 |
| 3 | EGFR-Ab(Cys)-EGFR-PEG5k (n = 2) | 4 | 0.5 | 5.0 | 1 | 0.25 | 24 |
| 4 | EGFR-Ab(Cys)-EGFR-PEG5k (n = 2) | 4 | 0.5 | 5.0 | 1 | 3 | 72 |
| 5 | EGFR-Ab(Lys-DHPz)-KRAS-PEG5k (n = 1) | 4 | 0.5 | 5.0 | 1 | 0.25 | 24 |
| 6 | EGFR-Ab(Lys-DHPz)-KRAS-PEG5k (n = 1) | 4 | 0.5 | 5.0 | 1 | 3 | 72 |
| 7 | EGFR-Ab(Lys-DHPz)-KRAS-PEG5k (n = 2) | 4 | 0.5 | 5.0 | 1 | 0.25 | 24 |
| 8 | EGFR-Ab(Lys-DHPz)-KRAS-PEG5k (n = 2) | 4 | 0.5 | 5.0 | 1 | 3 | 72 |
| 9 | EGFR-Ab(Asn297-DHPz)-KRAS-PEG5k (n = 1) | 4 | 0.125 | 5.0 | 1 | 0.25 | 24 |
| 10 | EGFR-Ab(Asn297-DHPz)-KRAS-PEG5k (n = 1) | 4 | 0.125 | 5.0 | 1 | 3 | 72 |
| 11 | EGFR-Ab(Asn297-DHPz)-KRAS-PEG5k (n = 2) | 4 | 0.125 | 5.0 | 1 | 0.25 | 24 |

TABLE 39-continued

| Gr | Test Article | N | siRNA Dose (mg/kg) | Dose Volume (mL/kg) | # of Doses | Survival Bleed (h) | Terminal Bleed (h) |
|---|---|---|---|---|---|---|---|
| 12 | EGFR-Ab(Asn297-DHPz)-KRAS-PEG5k (n = 2) | 4 | 0.125 | 5.0 | 1 | 3 | 72 |
| 13 | EGFR-Ab | 4 | 0.5 | 5.0 | 1 | 0.25 | 24 |
| 14 | EGFR-Ab | 4 | 0.5 | 5.0 | 1 | 3 | 72 |
| | Total # of Animals: | 56 | | WT mice CD-1 | | | |

Figure 69A:
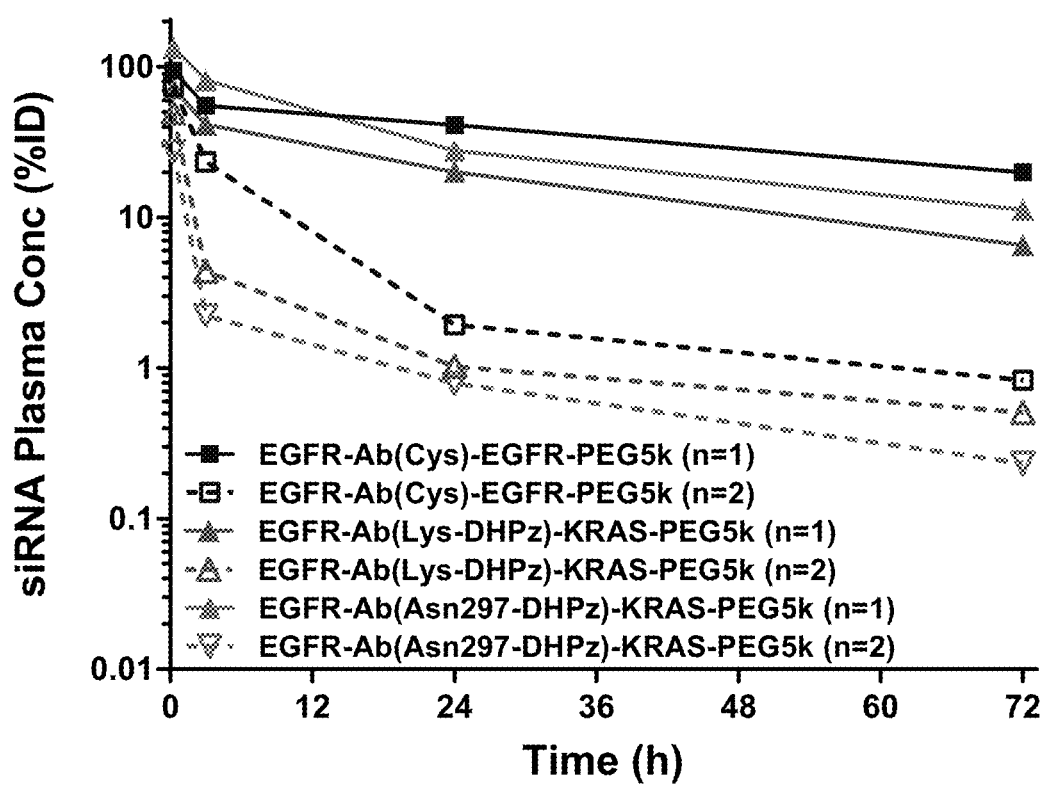
FIG. 69A illustrates plasma siRNA concentration of exemplary molecules described herein.
Figure 69B:
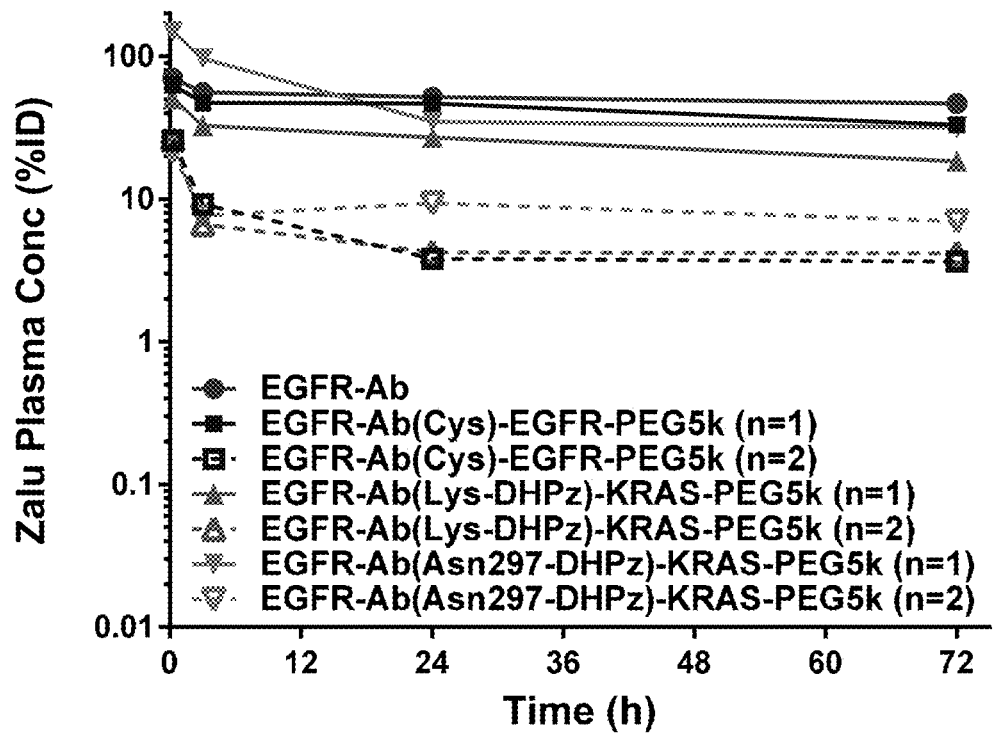
FIG. 69B shows antibody zalutumumab concentration of exemplary molecules described herein in the plasma at a 5 mg/kg dose.

In this in vivo PK study it was demonstrated the utility of site specific conjugation. As illustrated in FIG. 69A, the DAR1 (n=1) test article (group 9) had a comparable siRNA plasma clearance profile to the two controls (groups 1 and 5), with approximately 10% of the siRNA remaining in the plasma after 168 hours. All the DAR2 (n=2) conjugates had much faster clearance of the siRNA from the plasma relative to the DAR1 conjugates. As illustrated in FIG. 69B, the DAR1 (n=1) test article (group 9) had a comparable EGFR-Ab plasma clearance profile to the two controls (groups 1 and 5). All the DAR2 (n=2) conjugates had much faster clearance of the antibody from the plasma relative to the DAR1 conjugates.

In the above Examples, it was demonstrated the use of lysine and cysteine conjugation strategies to attach the siRNA to the antibody. In this example, it was demonstrated the utility of a site specific conjugation strategy and demonstrate the conjugate has comparable PK properties to non-specific conjugation strategies.

Example 28: 2016-PK-180-HCC827 siRNA Design and Synthesis

EFGR: A 21mer duplex with 19 bases of complementarity and 3' dinucleotide overhangs was designed against human EGFR. The sequence of the guide/antisense strand was complementary to the gene sequence starting a base position 333 for the human mRNA transcript for EGFR (ACUCGUGCCUUGGCAAACUUU; SEQ ID NO: 2082). Base, sugar and phosphate modifications were used to optimize the potency of the duplex and reduce immunogenicity. All siRNA single strands were fully assembled on solid phase using standard phosphoramidite chemistry and purified over HPLC. Purified single strands were duplexed to get the double stranded siRNA. The passenger strand contained two conjugation handles, a C6-NH2 at the 5' end and a C6-SH at the 3' end. Both conjugation handles were connected to siRNA passenger strand via phosphorothioate-inverted abasic-phosphorothioate linker, see Example 9 for the chemical structure.

Negative control siRNA sequence (scramble): A published (Burke et al. (2014) Pharm. Res., 31(12):3445-60) 21mer duplex with 19 bases of complementarity and 3' dinucleotide overhangs was used. The sequence (5' to 3') of the guide/antisense strand was UAUCGACGUGUCCAGC-UAGUU (SEQ ID NO: 2116). Base, sugar and phosphate modifications were used to reduce immunogenicity and were comparable to those used in the active siRNA. All siRNA single strands were fully assembled on solid phase using standard phosphoramidite chemistry and purified over HPLC. Purified single strands were duplexed to get the double stranded siRNA. The passenger strand contained two conjugation handles, a C6-NH2 at the 5' end and a C6-SH at the 3' end. Both conjugation handles were connected to siRNA passenger strand via a phosphodiester-inverted abasic-phosphodiester linker, see Example 9 for the chemical structure.

ASC Synthesis and Characterization

All conjugates were made and purified as a DAR1 (n=1) using ASC architecture-4, as described in Example 9.

In Vivo Study Design

Groups (n=5) of female NCr nu/nu mice bearing subcutaneously (SC) flank HCC827 tumors 100-300 mm³ in volume were treated with one intravenous (i.v.) tail vein injection of siRNA conjugate, while control group (n=5) of the same mice received one i.v. injection of PBS as a vehicle control. Table 40 describes the study design. Mice were sacrificed by $CO_2$ asphyxiation at 96 hours post-dose. 50 mg pieces of tumor and liver, were collected and snap-frozen in liquid nitrogen. mRNA knockdown in target tissue was determined using a comparative qPCR assay as described in Example 2. Total RNA was extracted from the tissue, reverse transcribed and mRNA levels were quantified using TaqMan qPCR, using the appropriately designed primers and probes. PP1B (housekeeping gene) was used as an internal RNA loading control, results were calculated by the comparative Ct method, where the difference between the target gene Ct value and the PPIB Ct value (ΔCt) is calculated and then further normalized relative to the PBS control group by taking a second difference (ΔΔCt). Quantitation of plasma and tissue siRNA concentrations were determined using a stem-loop qPCR assay as described in Example 2. The antisense strand of the siRNA was reverse transcribed using a TaqMan MicroRNA reverse transcription kit using a sequence-specific stem-loop RT primer. The cDNA from the RT step was then utilized for real-time PCR and Ct values were transformed into plasma and tissue concentrations using the linear equations derived from the standard curves.

TABLE 40

| Group | Test Article | N | SiRNA Dose (mg/kg) | ROA | Dose Volume (mL/kg) | # of Doses | Harvest Time (h) |
|---|---|---|---|---|---|---|---|
| 1 | EGFR-Ab(Cys)-EGFR-PEG5k (n = 1) | 5 | 1 | IV | 5.0 | 1 | 96 |
| 2 | EGFR-Ab(Cys)-EGFR-PEG5k (n = 1) | 5 | 0.5 | IV | 5.0 | 1 | 96 |
| 3 | EGFR-Ab(Cys)-EGFR-PEG5k (n = 1) | 5 | 0.25 | IV | 5.0 | 1 | 96 |
| 4 | EGFR-Ab(Cys)-ECL-EGFR-PEG5k (n = 1) | 5 | 1 | IV | 5.0 | 1 | 96 |
| 5 | EGFR-Ab(Cys)-ECL-EGFR-PEG5k (n = 1) | 5 | 0.5 | IV | 5.0 | 1 | 96 |

TABLE 40-continued

| Group | Test Article | N | SiRNA Dose (mg/kg) | ROA | Dose Volume (mL/kg) | # of Doses | Harvest Time (h) |
|---|---|---|---|---|---|---|---|
| 6 | EGFR-Ab(Cys)-ECL-EGFR-PEG5k (n = 1) | 5 | 0.25 | IV | 5.0 | 1 | 96 |
| 7 | EGFR-Ab(Cys)-EGFR-SS-PEG5k (n = 1) | 5 | 1 | IV | 5.0 | 1 | 96 |
| 8 | EGFR-Ab(Cys)-EGFR-SS-PEG5k (n = 1) | 5 | 0.5 | IV | 5.0 | 1 | 96 |
| 9 | EGFR-Ab(Cys)-EGFR-SS-PEG5k (n = 1) | 5 | 0.25 | IV | 5.0 | 1 | 96 |
| 10 | EGFR-Ab(Cys)-ECL-EGFR-SS-PEG5k (n = 1) | 5 | 1 | IV | 5.0 | 1 | 96 |
| 11 | EGFR-Ab(Cys)-ECL-EGFR-SS-PEG5k (n = 1) | 5 | 0.5 | IV | 5.0 | 1 | 96 |
| 12 | EGFR-Ab(Cys)-ECL-EGFR-SS-PEG5k (n = 1) | 5 | 0.25 | IV | 5.0 | 1 | 96 |
| 15 | EGFR-Ab(Cys)-scramble-PEG5k (n = 1) | 5 | 1 | IV | 5.0 | 1 | 96 |
| 16 | PBS Control | 5 | — | IV | 5.0 | 1 | 96 |
| | Total # of Animals: | 80 | | nu/nu mice with HCC827 tumors | | | |

Figure 70A:
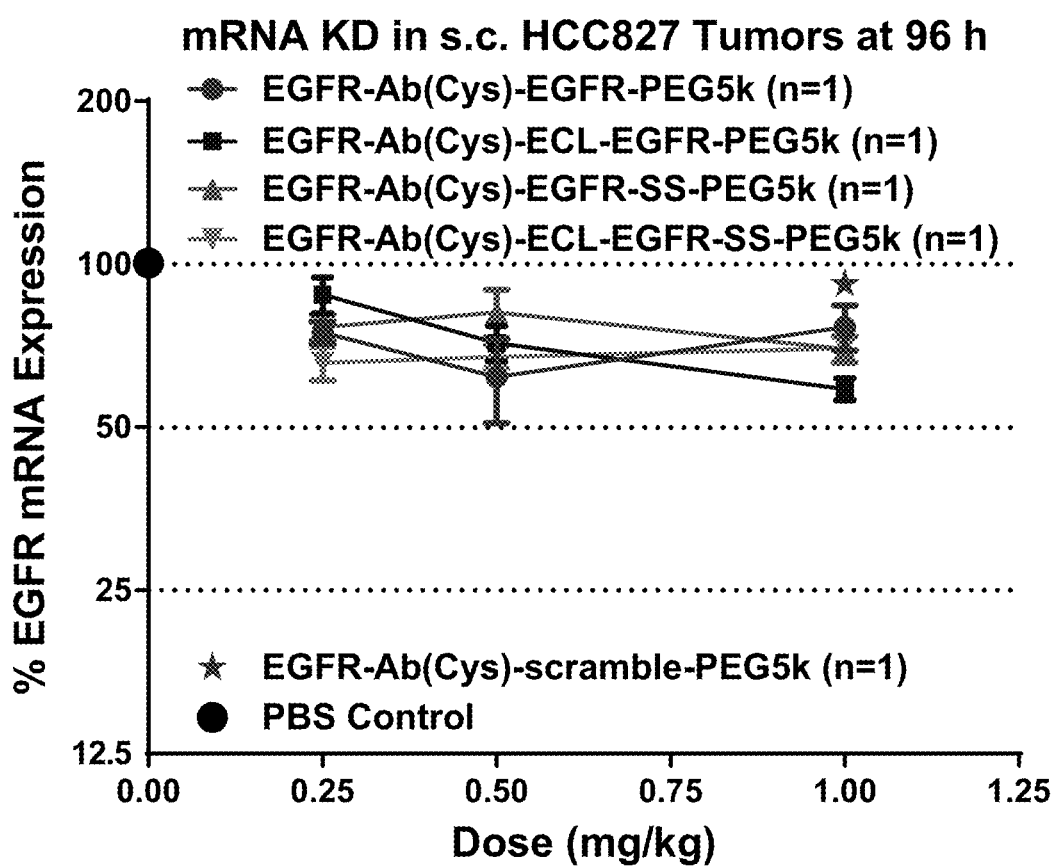
FIG. 70A shows mRNA expression level of exemplary molecules described herein.
Figure 70B:
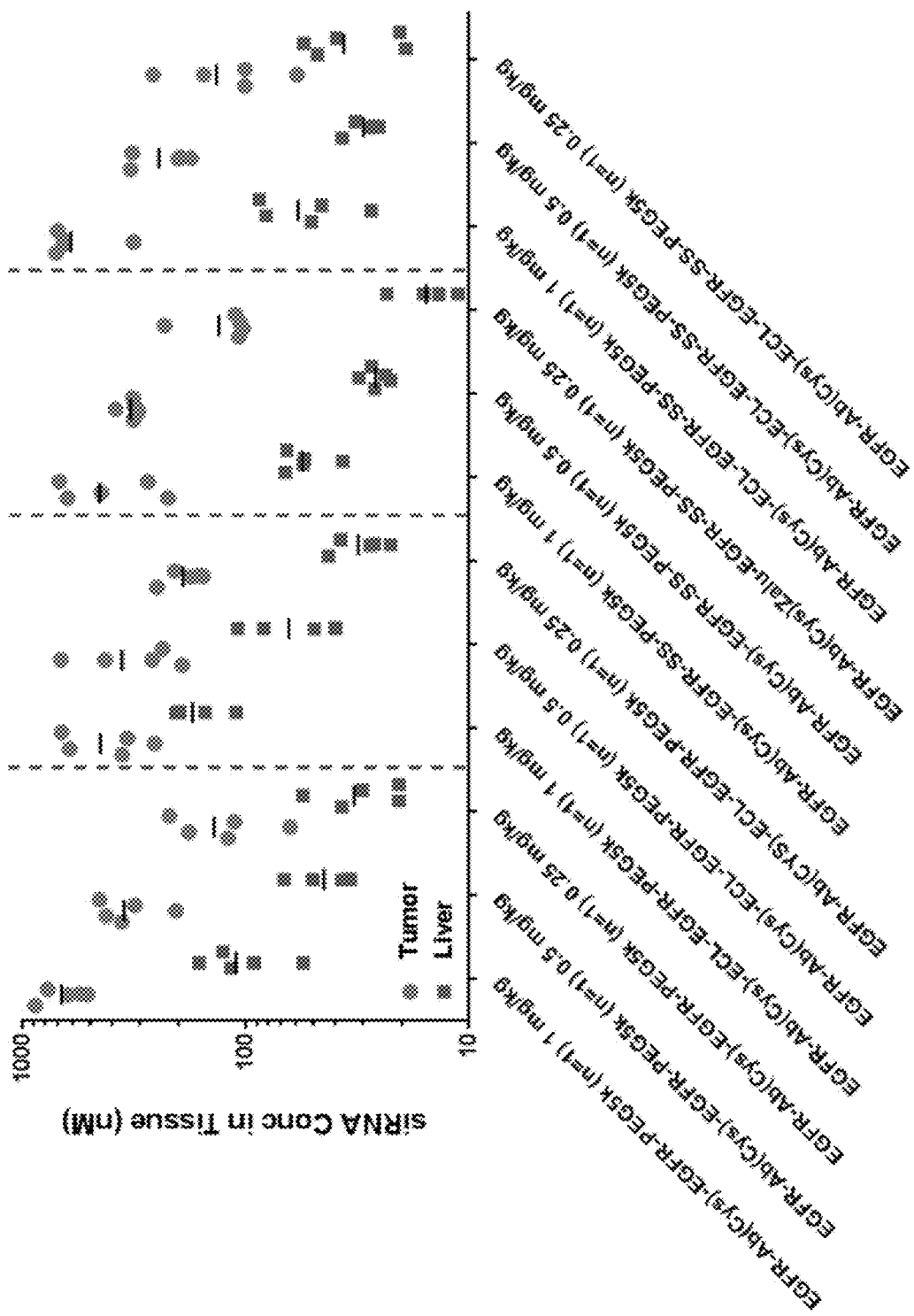
FIG. 70B shows siRNA concentration of exemplary molecules described herein in tumor or liver tissues.
Figure 70C:
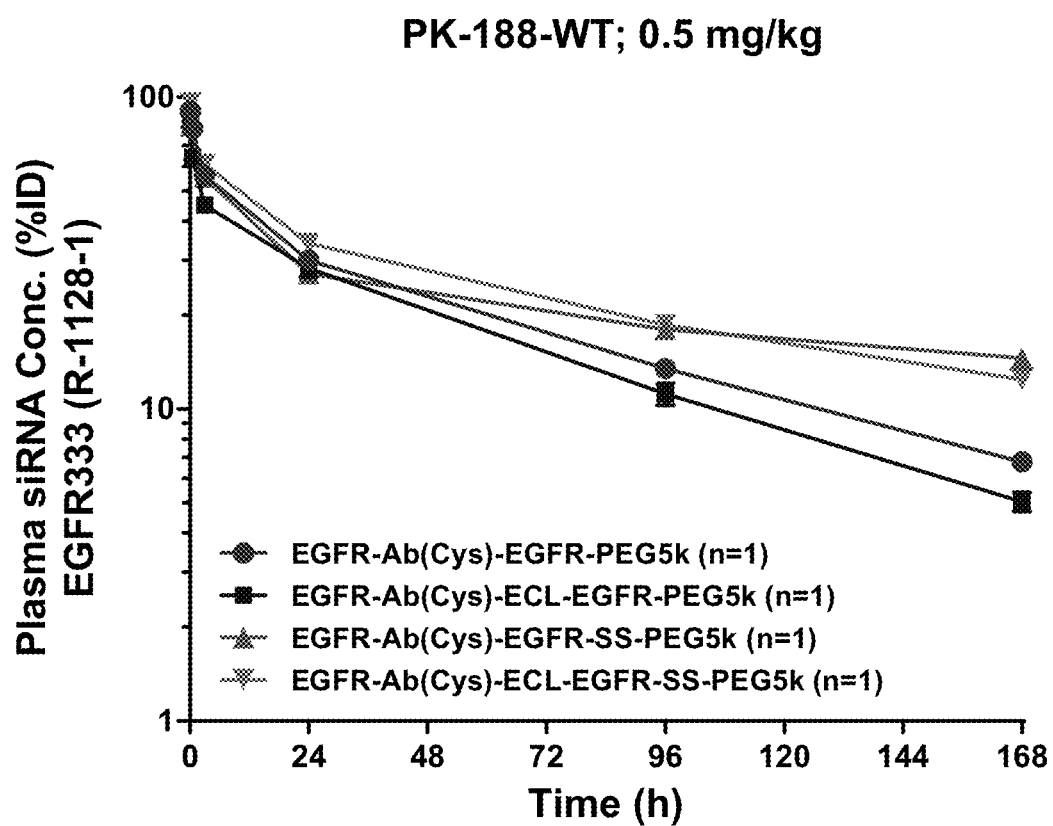
FIG. 70C shows plasma siRNA concentration of exemplary molecules described herein.
Figure 71B:
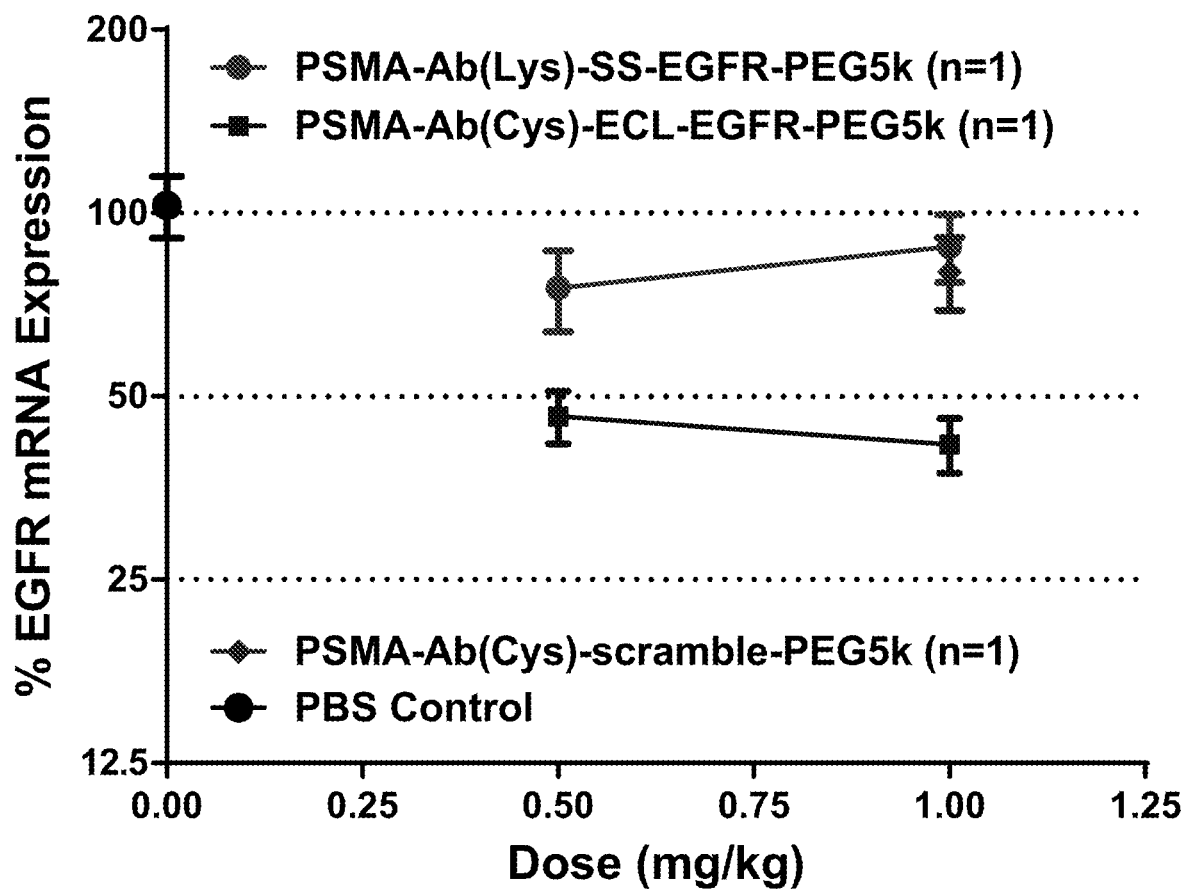
FIG. 71B-FIG. 71C illustrate mRNA expression level of exemplary molecules described herein in LNCaP tomor.
Figure 71C:
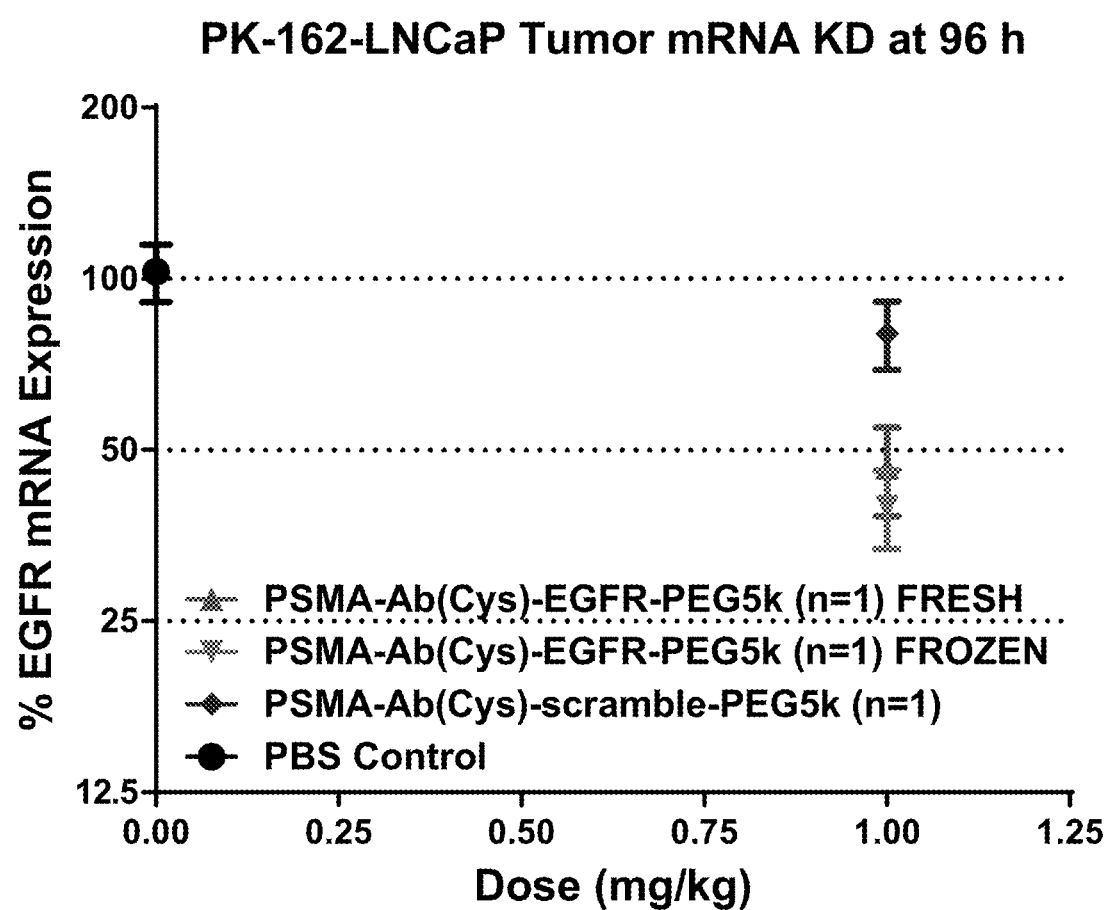

In this in vivo PK study, replacing the SMCC linker between the antibody and siRNA with an enzymatically cleavable linker and the introduction of a cleavable disulfide linker between the siRNA and PEG, or the combination of both were tested. As illustrated in FIG. 70A, all the linker combination were capable of EGFR mRNA knockdown in the HCC827 tumor cells relative to the scrambled control. As illustrated in FIG. 70B, all the linker combinations produced comparable siRNA tissue accumulation in the tumor and liver. As illustrated in FIG. 70C, all the conjugates were capable of maintaining high levels of siRNA in the plasma, with approximately 10% remaining in the plasma after 168 hours.

In this AXBYC example, it was demonstrated that different linker combinations ("X" and/or "Y") can be used to conjugate the siRNA to the antibody and PEG.

Example 29: 2016-PK-162-LNCaP

EFGR: A 21mer duplex with 19 bases of complementarity and 3' dinucleotide overhangs was designed against human EGFR. The sequence of the guide/antisense strand was complementary to the gene sequence starting a base position 333 for the human mRNA transcript for EGFR (ACUCGUGCCUUGGCAAACUUU; SEQ ID NO: 2082). Base, sugar and phosphate modifications were used to optimize the potency of the duplex and reduce immunogenicity. All siRNA single strands were fully assembled on solid phase using standard phosphoramidite chemistry and purified over HPLC. Purified single strands were duplexed to get the double stranded siRNA. The passenger strand contained two conjugation handles, a C6-NH2 at the 5' end and a C6-SH at the 3' end. Both conjugation handles were connected to siRNA passenger strand via phosphorothioate-inverted abasic-phosphorothioate linker, see Example 9 for the chemical structure.

Negative control siRNA sequence (scramble): A published (Burke et al. (2014) Pharm. Res., 31(12):3445-60) 21mer duplex with 19 bases of complementarity and 3' dinucleotide overhangs was used. The sequence (5' to 3') of the guide/antisense strand was UAUCGACGUGUCCAGCUAGUU (SEQ ID NO: 2116). Base, sugar and phosphate modifications were used to reduce immunogenicity and were comparable to those used in the active siRNA. All siRNA single strands were fully assembled on solid phase using standard phosphoramidite chemistry and purified over HPLC. Purified single strands were duplexed to get the double stranded siRNA. The passenger strand contained two conjugation handles, a C6-NH2 at the 5' end and a C6-SH at the 3' end. Both conjugation handles were connected to siRNA passenger strand via a phosphodiester-inverted abasic-phosphodiester linker, see Example 9 for the chemical structure.

ASC Synthesis and Characterization

All conjugates were made and purified as a DAR1 (n=1) using ASC architecture-4, as described in Example 9.

In Vivo Study Design

Groups 1-7 (n=5) of female SCID SHO mice bearing subcutaneous flank LNCaP tumors 100-350 mm$^3$ in volume were treated with one intravenous (i.v.) tail vein injection of siRNA conjugate, while control group 8 (n=5) of the same mice received one i.v. injection of PBS as a vehicle control. The table below describes the study design. Mice were sacrificed by $CO_2$ asphyxiation at 96 hours post-dose. 50 mg pieces of tumor and liver, were collected and snap-frozen in liquid nitrogen. mRNA knockdown in target tissue was determined using a comparative qPCR assay as described in Example 2. Total RNA was extracted from the tissue, reverse transcribed and mRNA levels were quantified using TaqMan qPCR, using the appropriately designed primers and probes. PPIB (housekeeping gene) was used as an internal RNA loading control, results were calculated by the comparative Ct method, where the difference between the target gene Ct value and the PPIB Ct value ($\Delta$Ct) is calculated and then further normalized relative to the PBS control group by taking a second difference ($\Delta\Delta$Ct). Quantitation of tissue siRNA concentrations were determined using a stem-loop qPCR assay as described in Example 2. The antisense strand of the siRNA was reverse transcribed using a TaqMan MicroRNA reverse transcription kit using a sequence-specific stem-loop RT primer. The cDNA from the RT step was then utilized for real-time PCR and Ct values were transformed into plasma or tissue concentrations using the linear equations derived from the standard curves.

TABLE 41

| Group | Test Article | N | SiRNA Dose (mg/kg) | ROA | Dose Volume (mL/kg) | # of Doses | Harvest Time (h) |
|---|---|---|---|---|---|---|---|
| 1 | PSMA-Ab(Lys)-SS-EGFR-PEG5k (n = 1) | 5 | 1 | IV | 5.0 | 1 | 96 |
| 2 | PSMA-Ab(Lys)-SS-EGFR-PEG5k (n = 1) | 5 | 0.5 | IV | 5.0 | 1 | 96 |
| 3 | PSMA-Ab(Cys)-ECL-EGFR-PEG5k (n = 1) | 5 | 1 | IV | 5.0 | 1 | 96 |
| 4 | PSMA-Ab(Cys)-ECL-EGFR-PEG5k (n = 1) | 5 | 0.5 | IV | 5.0 | 1 | 96 |
| 5 | PSMA-Ab(Cys)-EGFR-PEG5k (n = 1) FRESH | 5 | 1 | IV | 5.0 | 1 | 96 |
| 6 | PSMA-Ab(Cys)-EGFR-PEG5k (n = 1) FROZEN | 5 | 1 | IV | 5.0 | 1 | 96 |
| 7 | PSMA-Ab(Cys)-svcramble-PEG5k (n = 1) | 5 | 1 | IV | 5.0 | 1 | 96 |
| 8 | PBS Control | 5 | — | IV | 5.0 | 1 | 96 |
| | Total # of Animals: | 40 | | SCID SHO mice with LNCaP tumors | | | |

In this in vivo PK study, a disulfide (SS), enzymatically cleavable (ECL) or SMCC linker was used between the antibody and siRNA. As illustrated in graph 1 on slide 42, the tumor tissue accumulation of the siRNA was reduced when the cleavable disulfide leaker was used instead of the ECL or SMCC linkers. As illustrated on graph 2 on slide 42, the ECL linker strategy produced EGFR mRNA knockdown in the LNCaP tumor cells relative to the scrambled control. However, the SS linker failed to produce EGFR mRNA knockdown in the LNCaP tumor cells relative to the scrambled control. In addition to these linker experiments, the feasibility of −80° C. storage of the ASC was examined. The Formulation was snap-frozen in liquid nitrogen at 5 mg/ml antibody concentration, thawed at room temperature after 30 days storage at −80° C. and diluted to the required dosing concentration prior to administration. As illustrated on graph 3 on slide 42, the construct stored at −80° C., thawed prior to administration, retained its ability to produce EGFR mRNA knockdown in the LNCaP tumor cells relative to the scrambled control.

In this AXBYC example, it was demonstrated that an ECL linker ("X") can be used to conjugate the antibody to the siRNA and that an ASC can be stored at −80° C. for 1 month and thawed prior to administration.

Example 30: 2016-PK-181-HCC827 siRNA Design and Synthesis

EFGR: A 21mer duplex with 19 bases of complementarity and 3' dinucleotide overhangs was designed against human EGFR. The sequence of the guide/antisense strand was complementary to the gene sequence starting a base position 333 for the human mRNA transcript for EGFR (ACUCGUGCCUUGGCAAACUUU; SEQ ID NO: 2082). Base, sugar and phosphate modifications that are well described in the field of RNAi were used to optimize the potency of the duplex and reduce immunogenicity. All siRNA single strands were fully assembled on solid phase using standard phospharamidite chemistry and purified over HPLC. Purified single strands were duplexed to get the double stranded siRNA. The passenger strand contained two conjugation handles, a C6-NH2 at the 5' end and a C6-SH at the 3' end. Both conjugation handles were connected to siRNA passenger strand via phosphorothioate-inverted abasic-phosphorothioate linker, see Example 9 for the chemical structure.

Negative control siRNA sequence (scramble): A published (Burke et al. (2014) Pharm. Res., 31(12):3445-60) 21mer duplex with 19 bases of complementarity and 3' dinucleotide overhangs was used. The sequence (5' to 3') of the guide/antisense strand was UAUCGACGUGUCCAGC-UAGUU (SEQ ID NO: 2116). Base, sugar and phosphate modifications were used to reduce immunogenicity and were comparable to those used in the active siRNA. All siRNA single strands were fully assembled on solid phase using standard phospharamidite chemistry and purified over HPLC. Purified single strands were duplexed to get the double stranded siRNA. The passenger strand contained two conjugation handles, a C6-N H2 at the 5' end and a C6-SH at the 3' end. Both conjugation handles were connected to siRNA passenger strand via a phosphodiester-inverted abasic-phosphodiester linker, see Example 9 for the chemical structure.

ASC Synthesis and Characterization

All conjugates were made and purified as a DAR1 (n=1) using ASC architecture-4, as described in Example 9.

In Vivo Study Design

Groups (n=5) of female NCr nu/nu mice bearing subcutaneously (SC) flank HCC827 tumors 100-300 mm³ in volume were treated with one intravenous (i.v.) tail vein injection of siRNA conjugate, while control group (n=5) of the same mice received one i.v. injection of PBS as a vehicle control. Table 42 describes the study design. Mice were sacrificed by $CO_2$ asphyxiation at 96 hours post-dose. 50 mg pieces of tumor and liver, were collected and snap-frozen in liquid nitrogen. mRNA knockdown in target tissue was determined using a comparative qPCR assay as described in Example 2. Total RNA was extracted from the tissue, reverse transcribed and mRNA levels were quantified using TaqMan qPCR, using the appropriately designed primers and probes. PPIB (housekeeping gene) was used as an internal RNA loading control, results were calculated by the comparative Ct method, where the difference between the target gene Ct value and the PPIB Ct value (ΔCt) is calculated and then further normalized relative to the PBS control group by taking a second difference (ΔΔCt). Quantitation of tissue siRNA concentrations were determined using a stem-loop qPCR assay as described in the methods section. The antisense strand of the siRNA was reverse transcribed using a TaqMan MicroRNA reverse transcription kit using a sequence-specific stem-loop RT primer. The cDNA from the RT step was then utilized for real-time PCR and Ct values were transformed into tissue concentrations using the linear equations derived from the standard curves.

TABLE 42

| Group | Test Article | N | SiRNA Dose (mg/kg) | ROA | Dose Volume (mL/kg) | # of Doses | Harvest Time (h) |
|---|---|---|---|---|---|---|---|
| 1 | EGFR-Ab(Cys)-EGFR-PEG5k (n = 1) | 5 | 1 | IV | 5.0 | 1 | 96 |
| 2 | EGFR-Ab(Cys)-EGFR-PEG5k (n = 1) | 5 | 0.5 | IV | 5.0 | 1 | 96 |
| 3 | EGFR-Ab(Cys)-SS-EGFR-PEG5k (n = 1) | 5 | 1 | IV | 5.0 | 1 | 96 |
| 4 | EGFR-Ab(Cys)-SS-EGFR-PEG5k (n = 1) | 5 | 0.5 | IV | 5.0 | 1 | 96 |
| 6 | EGFR-Ab(Cys)-scramble-PEG5k (n = 1) | 5 | 1 | IV | 5.0 | 1 | 96 |
| 7 | EGFR-Ab(Cys)-scramble-PEG5k (n = 1) | 5 | 0.5 | IV | 5.0 | 1 | 96 |
| 8 | PBS Control | 5 | — | IV | 5.0 | 1 | 96 |
| | Total # of Animals: | 80 | | nu/nu mice with HCC827 tumors | | | |

Figure 72A:
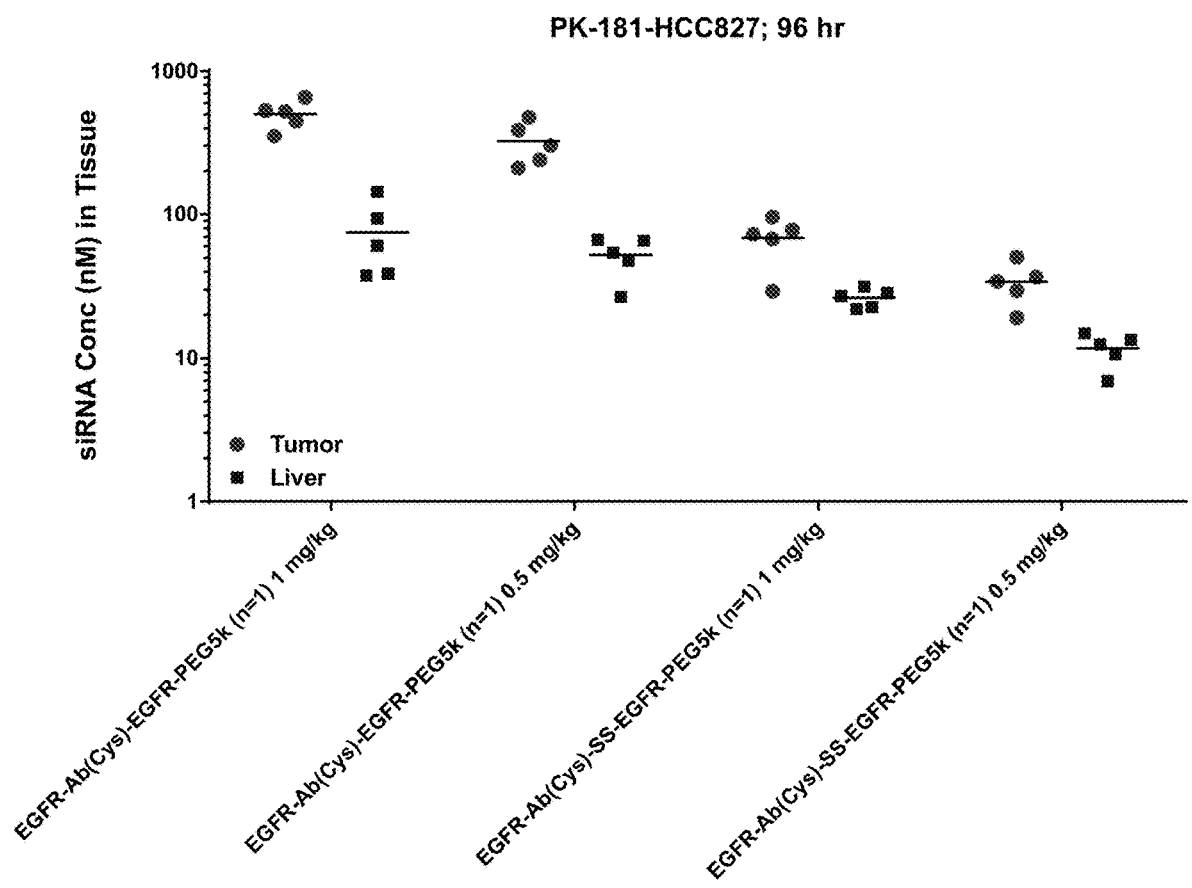
FIG. 72A illustrates siRNA concentration of exemplary molecules described herein in tissue.
Figure 72B:
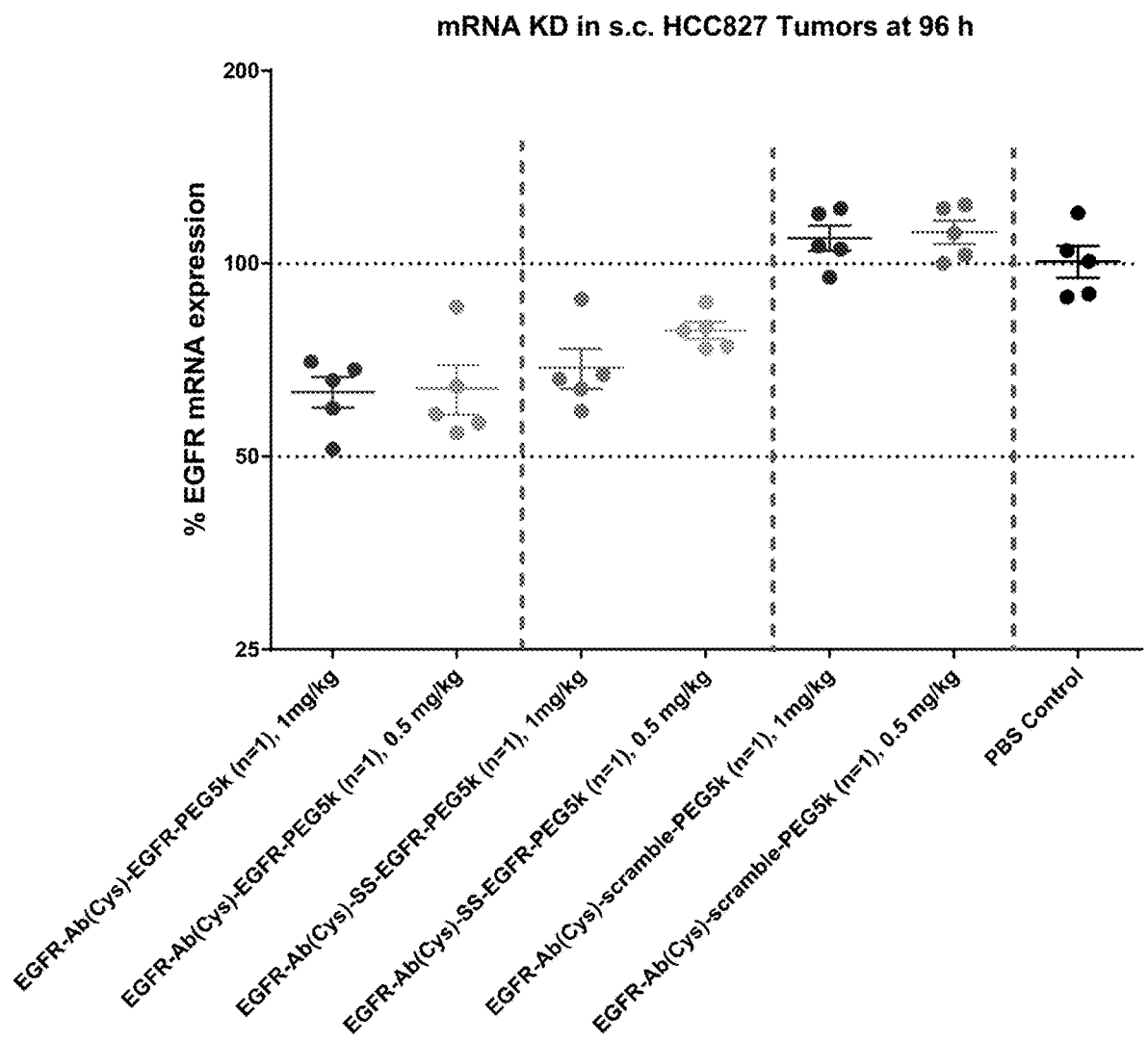
FIG. 72B shows mRNA expression level of exemplary molecules described herein in HCC827 tumors at 96 h post-treatment.

In this in vivo PK study, a disulfide or SMCC linker was used between the antibody and siRNA. As illustrated in FIG. 72A, the tumor tissue accumulation of the siRNA was reduced when the cleavable disulfide leaker was used instead of the more stable SMCC linker. As illustrated in FIG. 72B, both linker strategies were capable of producing EGFR mRNA knockdown in the HCC827 tumor cells relative to the scrambled control.

In this AXBYC example, it was demonstrated the use of a cleavable disulfide linker ("X") between the antibody and siRNA.

Example 31: 2016-PK-220-WT siRNA Design and Synthesis

KRAS: A 21mer duplex with 19 bases of complementarity and 3' dinucleotide overhangs was designed against human KRAS. The sequence of the guide/antisense strand was complementary to the gene sequence starting a base position 237 for the human mRNA transcript for KRAS (Guide strand sequence: UGAAUUAGCUGUAUCGUCAUU; SEQ ID NO: 2088). Base, sugar and phosphate modifications were used to optimize the potency of the duplex and reduce immunogenicity. All siRNA single strands were fully assembled on solid phase using standard phosphoramidite chemistry and purified over HPLC. Purified single strands were duplexed to get the double stranded siRNA. The passenger strand contained two conjugation handles, a C6-NH2 at the 5' end and a C6-SH at the 3' end. Both conjugation handles were connected to siRNA passenger strand via phosphorothioate-inverted abasic-phosphorothioate linker, see Example 9 for the chemical structure.

ASC Synthesis and Characterization

All conjugates were made and purified as a DAR1 (n=1) using ASC architecture-4, as described in Example 9.

In Vivo Study Design

Groups (n=4) of wild-type female CD-1 mice were treated with one intravenous (i.v.) tail vein injections of siRNA conjugates. Treatment groups received 0.5 mg/kg (based on the weight of siRNA) and all groups were administered a dose volume of 5.0 mL/kg. Table 43 illustrates the study design in more detail. Non-terminal blood samples were collected at 5, 30, and 180 minutes post-dose via puncture of the retro-orbital plexus and centrifuged to generate plasma for PK analysis. Mice were sacrificed by $CO_2$ asphyxiation at 24, 96, or 168 hours post-dose. Terminal blood samples were collected via cardiac puncture and processed to generate plasma for PK analysis. Quantitation of plasma siRNA concentrations were determined using a stem-loop qPCR assay as described in Example 2. The antisense strand of the siRNA was reverse transcribed using a TaqMan MicroRNA reverse transcription kit using a sequence-specific stem-loop RT primer. The cDNA from the RT step was then utilized for real-time PCR and Ct values were transformed into plasma or tissue concentrations using the linear equations derived from the standard curves. Plasma concentrations of antibody were determined using an ELISA assay.

TABLE 43

| Gr | Test Article | N | siRNA Dose (mg/kg) | ROA | Dose Volume (mL/kg) | # of Doses | Survival Bleed (h) | Terminal Bleed (h) |
|---|---|---|---|---|---|---|---|---|
| 1 | EGFR-Ab(Lys)-SPDP-KRAS-PEG5k | 4 | 0.5 | IV | 5.0 | 1 | 5 | 24 |
| 2 | (n = 1) | 4 | 0.5 | IV | 5.0 | 1 | 30 | 96 |
| 3 | | 4 | 0.5 | IV | 5.0 | 1 | 180 | 168 |
| 4 | EGFR-Ab(Cys)-SPDP-KRAS-PEG5k | 4 | 0.5 | IV | 5.0 | 1 | 5 | 24 |
| 5 | (n = 1) | 4 | 0.5 | IV | 5.0 | 1 | 30 | 96 |
| 6 | | 4 | 0.5 | IV | 5.0 | 1 | 180 | 168 |
| 7 | EGFR-Ab(Cys)-SMPT-KRAS-PEG5k | 4 | 0.5 | IV | 5.0 | 1 | 5 | 24 |
| 8 | (n = 1) | 4 | 0.5 | IV | 5.0 | 1 | 30 | 96 |
| 9 | | 4 | 0.5 | IV | 5.0 | 1 | 180 | 168 |
| 10 | EGFR-Ab(Cys)-SS(methyl)-KRAS-PEG5k | 4 | 0.5 | IV | 5.0 | 1 | 5 | 24 |
| 11 | (n = 1) | 4 | 0.5 | IV | 5.0 | 1 | 30 | 96 |
| 12 | | 4 | 0.5 | IV | 5.0 | 1 | 180 | 168 |
| 13 | EGFR-Ab(Cys)-SS(dimethyl)- | 4 | 0.5 | IV | 5.0 | 1 | 5 | 24 |
| 14 | KRAS-PEG5k (n = 1) | 4 | 0.5 | IV | 5.0 | 1 | 30 | 96 |
| 15 | | 4 | 0.5 | IV | 5.0 | 1 | 180 | 168 |
| | Total # of Animals: | 60 | | WT mice CD-1 | | | | |

Figure 73A:
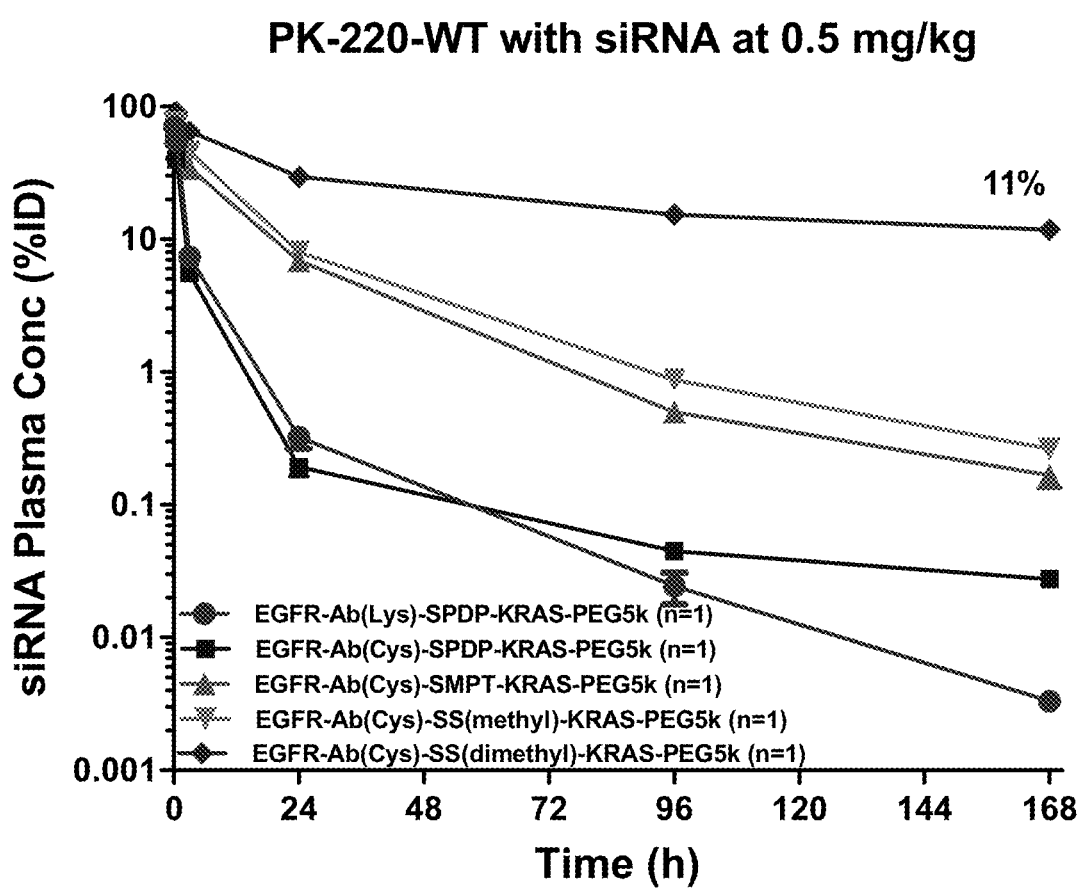
FIG. 73A illustrates siRNA concentration of exemplary molecules described herein in the plasma at a 0.5 mg/kg dose.
Figure 73B:
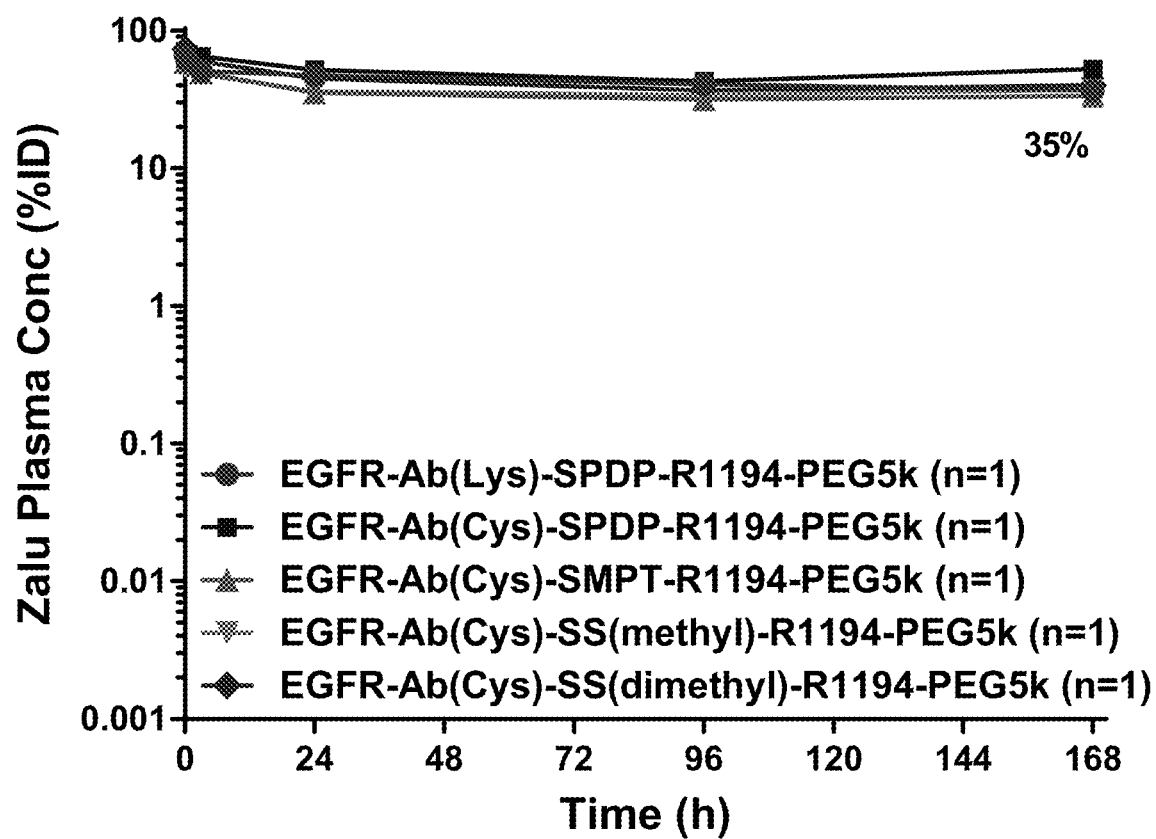
FIG. 73B shows antibody zalutumumab concentration of exemplary molecules described herein in the plasma at a 5 mg/kg dose.
Figure 74:
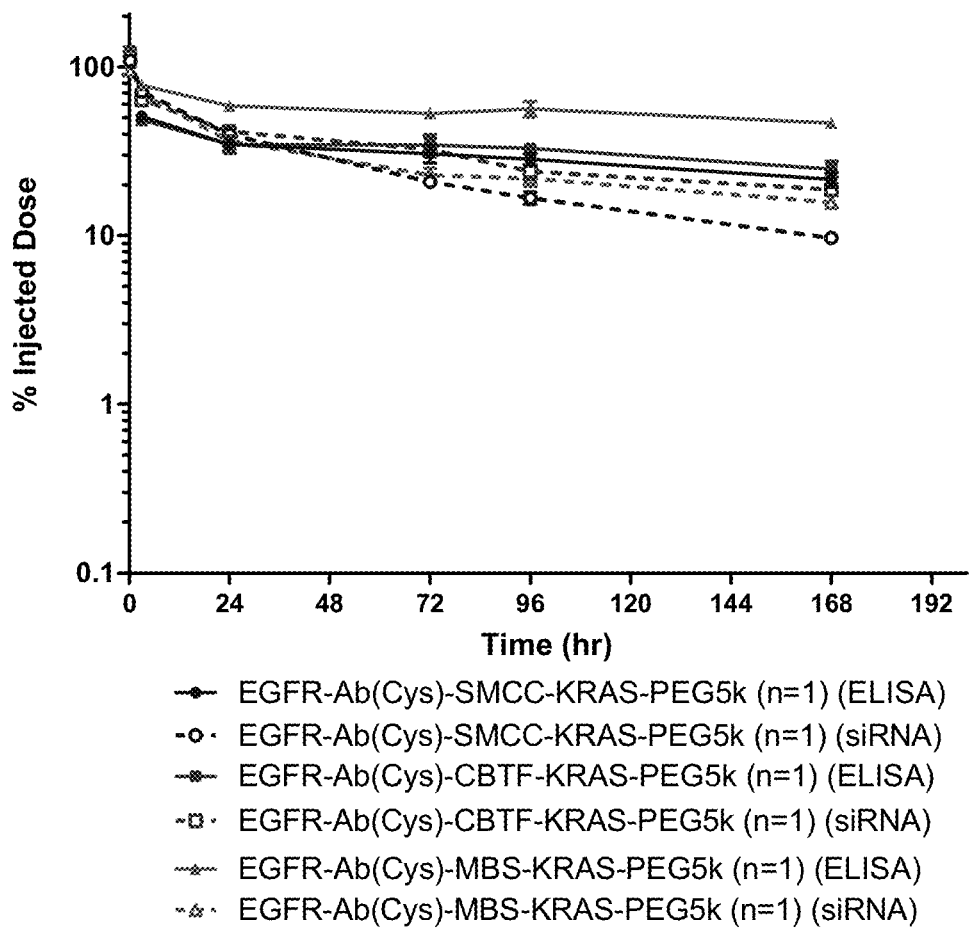
FIG. 74 illustrates plasma clearance of exemplary molecules encompassed by Formula (I) which contains different linkers.

In this in vivo PK study, different disulfide linkers were explored, with varying degrees of steric hindrance, to understand how the rate of disulfide cleavage impacts ASC plasma PK. As illustrated in FIG. 73A, the clearance of the siRNA from the plasma was modulated by varying the degree of steric hindrance of the disulfide linker. FIG. 73B illustrates the clearance of the antibody zalutumumab from the plasma.

In this example, it was demonstrated biological activity with a range of different AXBYC conjugates in which a range of different disulfide linkers ("X") can be used to conjugate the siRNA to the antibody.

Example 32: 2016-PK-256-WT siRNA Design and Synthesis

KRAS: A 21mer duplex with 19 bases of complementarity and 3' dinucleotide overhangs was designed against human KRAS. The sequence of the guide/antisense strand was complementary to the gene sequence starting a base position 237 for the human mRNA transcript for KRAS (Guide strand sequence: UGAAUUAGCUGUAUCGUCAUU; SEQ ID NO: 2088). Base, sugar and phosphate modifications were used to optimize the potency of the duplex and reduce immunogenicity. All siRNA single strands were fully assembled on solid phase using standard phospharamidite chemistry and purified over HPLC. Purified single strands were duplexed to get the double stranded siRNA. The passenger strand contained two conjugation handles, a C6-NI-12 at the 5' end and a C6-SH at the 3' end. Both conjugation handles were connected to siRNA passenger strand via phosphorothioate-inverted abasic-phosphorothioate linker, see Example 9 for the chemical structure.

ASC Synthesis and Characterization

All conjugates were made and purified as a DAR1 (n=1) using ASC architecture-4, as described in Example 9.

In Vivo Study Design

Groups (n=4) of wild-type female CD-1 mice were treated with one intravenous (i.v.) tail vein injections of siRNA conjugates. Treatment groups received 0.5 mg/kg (based on the weight of siRNA) and all groups were administered a dose volume of 5.0 mL/kg. Table 44 illustrates the study design in more detail. Non-terminal blood samples were collected at 0.25, 3, and 24 hours post-dose via puncture of the retro-orbital plexus and centrifuged to generate plasma for PK analysis. Mice were sacrificed by $CO_2$ asphyxiation at 72, 96, or 168 h post-dose. Terminal blood samples were collected via cardiac puncture and processed to generate plasma for PK analysis. Quantitation of plasma siRNA concentrations were determined using a stem-loop qPCR assay as described in Example 2. The antisense strand of the siRNA was reverse transcribed using a TaqMan MicroRNA reverse transcription kit using a sequence-specific stem-loop RT primer. The cDNA from the RT step was then utilized for real-time PCR and Ct values were transformed into plasma or tissue concentrations using the linear equations derived from the standard curves. Plasma concentrations of antibody were determined using an ELISA assay.

TABLE 44

| Gr | Test Article | N | siRNA Dose (mg/kg) | ROA | Dose Volume (mL/kg) | # of Doses | Survival Bleed (h) | Terminal Bleed (h) |
|---|---|---|---|---|---|---|---|---|
| 1 | EGFR-Ab(Cys)-SMCC-KRAS-PEG5k (n = 1) | 4 | 0.5 | IV | 5.0 | 1 | 0.25 | 72 |
| 2 | EGFR-Ab(Cys)-SMCC-KRAS-PEG5k (n = 1) | 4 | 0.5 | IV | 5.0 | 1 | 3 | 96 |
| 3 | EGFR-Ab(Cys)-SMCC-KRAS-PEG5k (n = 1) | 4 | 0.5 | IV | 5.0 | 1 | 24 | 168 |
| 4 | EGFR-Ab(Cys)-CBTF-KRAS-PEG5k (n = 1) | 4 | 0.5 | IV | 5.0 | 1 | 0.25 | 72 |
| 5 | EGFR-Ab(Cys)-CBTF-KRAS-PEG5k (n = 1) | 4 | 0.5 | IV | 5.0 | 1 | 3 | 96 |
| 6 | EGFR-Ab(Cys)-CBTF-KRAS-PEG5k (n = 1) | 4 | 0.5 | IV | 5.0 | 1 | 24 | 168 |
| 7 | EGFR-Ab(Cys)-MBS-KRAS-PEG5k (n = 1) | 4 | 0.5 | IV | 5.0 | 1 | 0.25 | 72 |
| 8 | EGFR-Ab(Cys)-MBS-KRAS-PEG5k (n = 1) | 4 | 0.5 | IV | 5.0 | 1 | 3 | 96 |
| 9 | EGFR-Ab(Cys)-MBS-KRAS-PEG5k (n = 1) | 4 | 0.5 | IV | 5.0 | 1 | 24 | 168 |
| | Total # of Animals: | 60 | | | WT mice CD-1 | | | |

In this in vivo PK study a range of different linkers between the antibody and siRNA were tested to determine the effect on plasma clearance. As illustrated on the graph on slide 45, all the conjugates were capable of maintaining high levels of siRNA in the plasma, with greater than 10% remaining in the plasma after 168 hours.

In this example, it was demonstrated biological activity with a range of different AXBYC conjugates in which a range of different linkers ("Y") can be used to conjugate the siRNA to the antibody while maintaining the improved plasma kinetics over those historically observed for unconjugated siRNA.

Example 33: 2016-PK-237-HCC827 siRNA Design and Synthesis

EFGR: A 21mer duplex with 19 bases of complementarity and 3' dinucleotide overhangs was designed against human EGFR. The sequence of the guide/antisense strand was complementary to the gene sequence starting a base position 333 for the human mRNA transcript for EGFR (Guide strad sequence: ACUCGUGCCUUGGCAAACUUU; SEQ ID NO: 2082). Base, sugar and phosphate modifications were used to optimize the potency of the duplex and reduce immunogenicity. All siRNA single strands were fully assembled on solid phase using standard phospharamidite chemistry and purified over HPLC. Purified single strands were duplexed to get the double stranded siRNA.

Two different passenger strands were made containing two conjugation handles (C6-NH$_2$ and C6-SH) in two different orientations (S5'-EGFR-3'N and N5'-EGFR-3'S). In the N5'-EGFR-3'S passenger strand both conjugation handles were connected to siRNA passenger strand via phosphorothioate-inverted abasic-phosphorothioate linker, were determined using a stem-loop qPCR assay as described in Example 2. The antisense strand of the siRNA was reverse transcribed using a TaqMan MicroRNA reverse transcription kit using a sequence-specific stem-loop RT primer. The cDNA from the RT step was then utilized for real-time PCR and Ct values were transformed into plasma or tissue concentrations using the linear equations derived from the standard curves.

TABLE 45

| Gr | Test Article | N | siRNA Dose (mg/kg) | ROA | Dose Volume (mL/kg) | # of Doses | Survival Bleed (h) | Terminal Bleed (h) | Harvest Time (h) |
|---|---|---|---|---|---|---|---|---|---|
| 1 | EGFR-Ab(Cys)-S5'-EGFR-3'N-PEG5k (n = 1) | 5 | 0.5 | IV | 5.0 | 1 | 0.25 | 72 | 72 |
| 2 | EGFR-Ab(Cys)-S5'-EGFR-3'N-PEG5k (n = 1) | 5 | 0.5 | IV | 5.0 | 1 | 3 | 96 | 96 |
| 3 | EGFR-Ab(Cys)-S5'-EGFR-3'N-PEG5k (n = 1) | 5 | 0.5 | IV | 5.0 | 1 | 24 | 168 | 168 |
| 4 | EGFR-Ab(Cys)-N5'-EGFR-3'S-PEG5k (n = 1) | 5 | 0.5 | IV | 5.0 | 1 | 0.25 | 72 | 72 |
| 5 | EGFR-Ab(Cys)-N5'-EGFR-3'S-PEG5k (n = 1) | 5 | 0.5 | IV | 5.0 | 1 | 3 | 96 | 96 |
| 6 | EGFR-Ab(Cys)-N5'-EGFR-3'S-PEG5k (n = 1) | 5 | 0.5 | IV | 5.0 | 1 | 24 | 168 | 168 |
| 7 | PBS Control | 5 | — | IV | 5.0 | 1 | — | — | 96 |
| Total # of Animals: | | 65 | | | nu/nu mice with HCC827 tumors | | | | | see Example 9 for the chemical structure. In the S5'-EGFR-3'N passenger strand both conjugation handles were connected to siRNA passenger strand via phosphodiester-inverted abasic-phosphorothioate linker. The C6-NH2 and C6-SH were connected through the phosphodiester, see Example 9 for the chemical structure.

ASC Synthesis and Characterization

The conjugate for groups 1-3 was made and purified as a DAR1 (n=1) using ASC architecture-4, as described in Example 9. The conjugate for groups 4-6 was made and purified as a DAR1 (n=1) using ASC architecture-2, as described in Example 9.

In Vivo Study Design

Figure 75A:
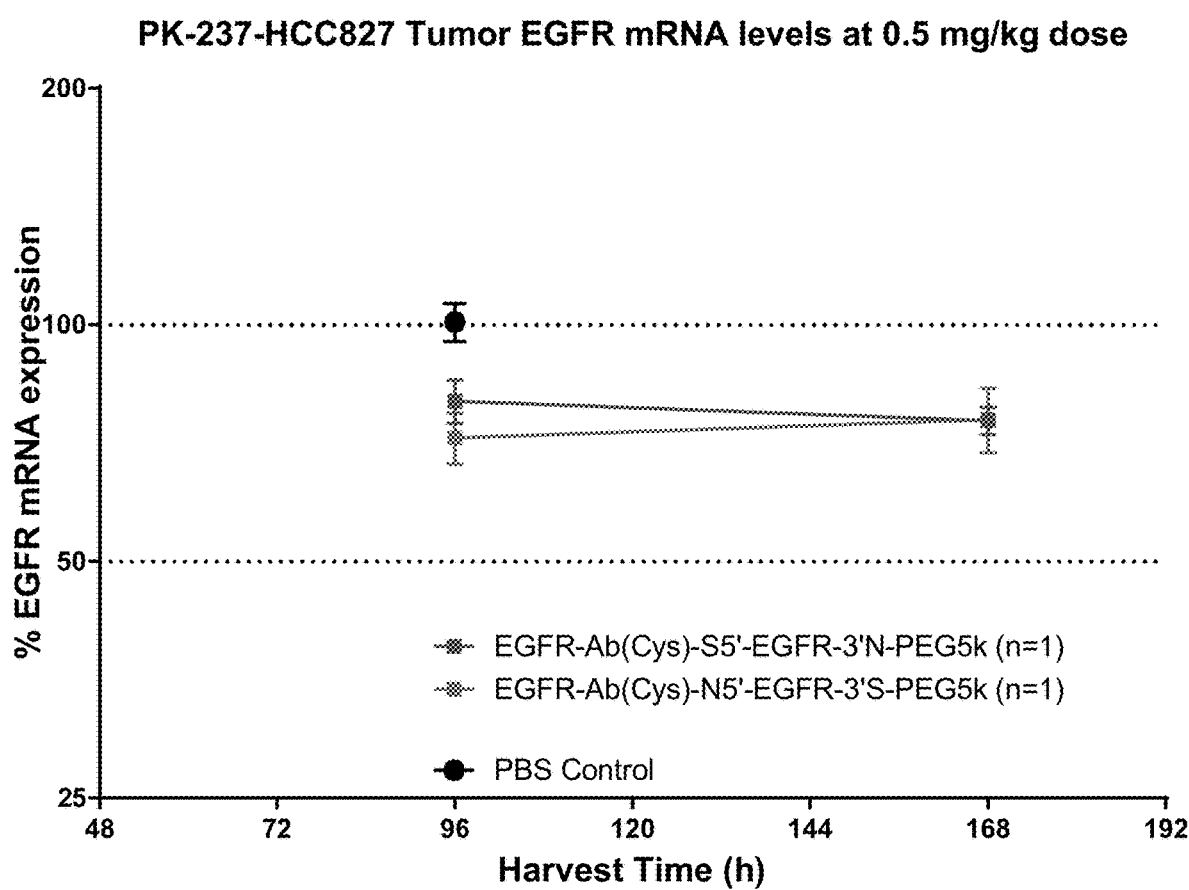
FIG. 75A illustrates the mRNA expression level of exemplary molecules described herein in HCC827 tumor at a 0.5 mg/kg dose.
Figure 75B:
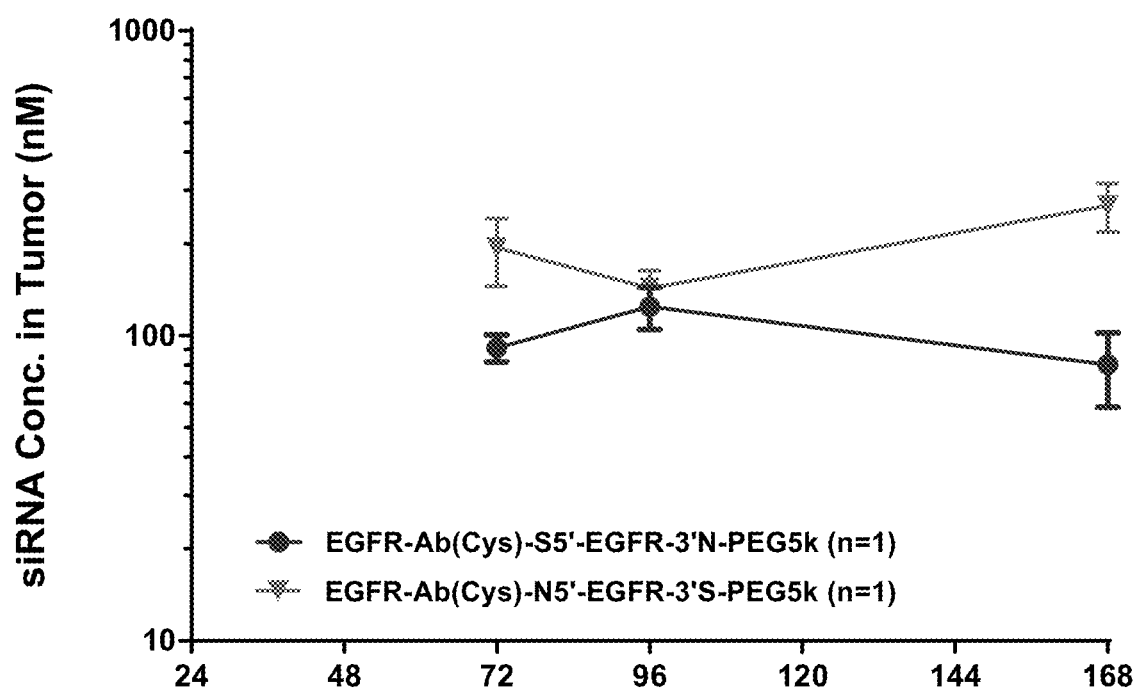
FIG. 75B-FIG. 75D illustrate siRNA concentration in tumor (FIG. 75B), liver (FIG. 75C), and plasma (FIG. 75D).
Figure 75C:
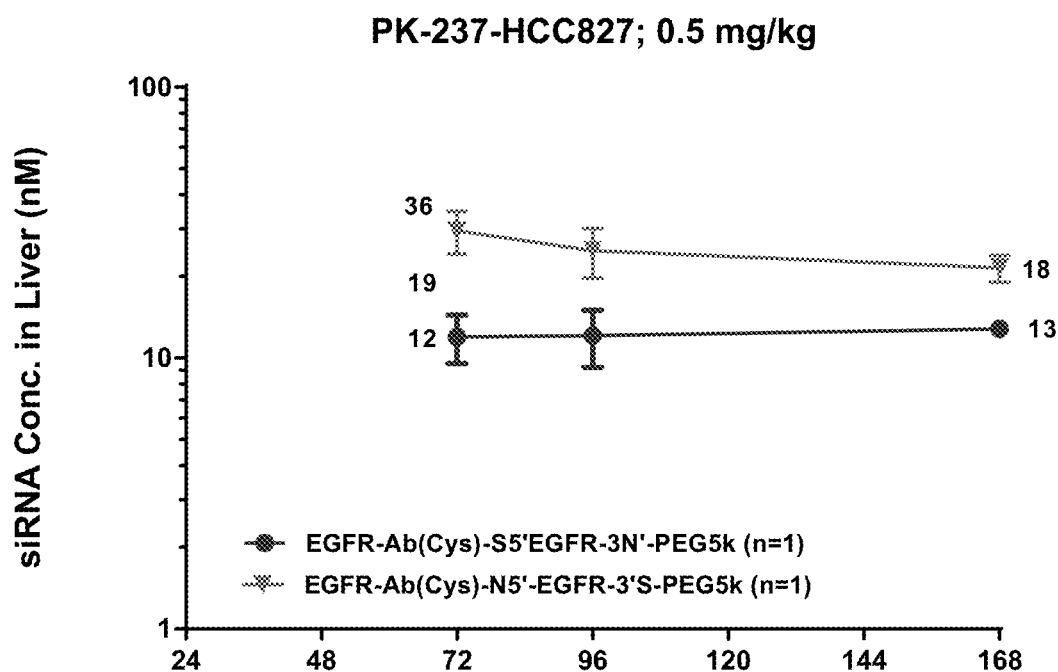
Figure 75D:
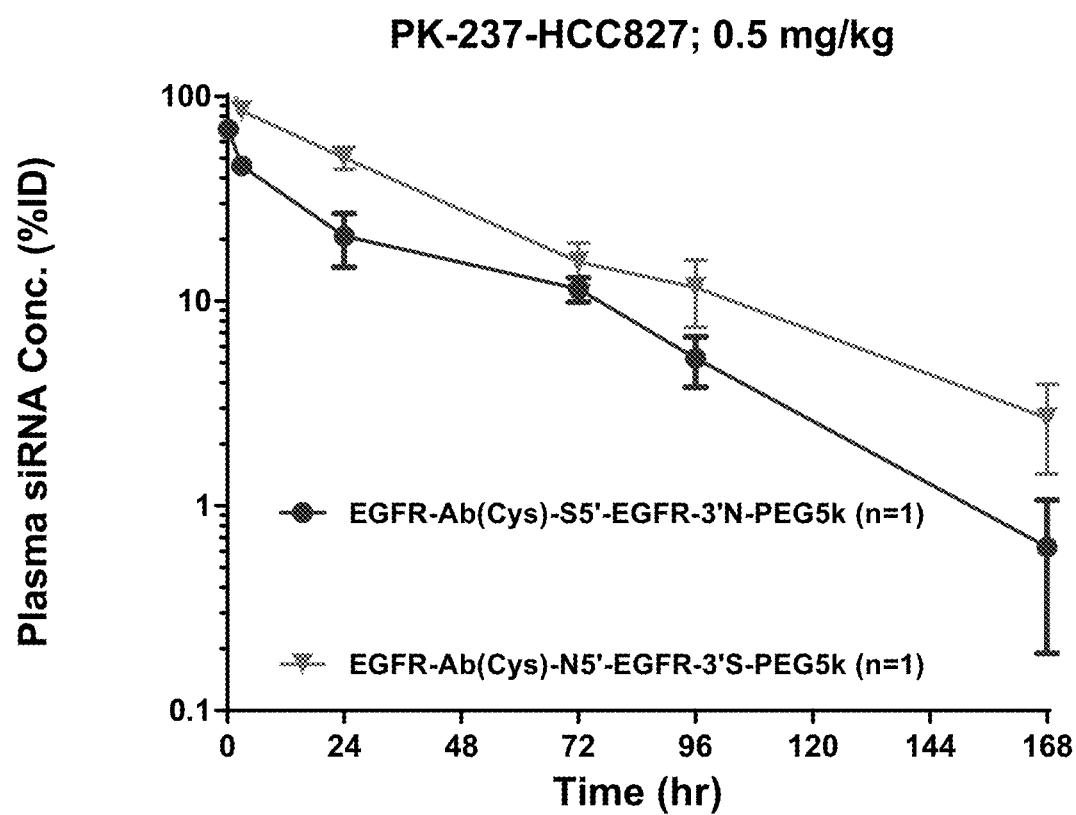
Figure 76A:
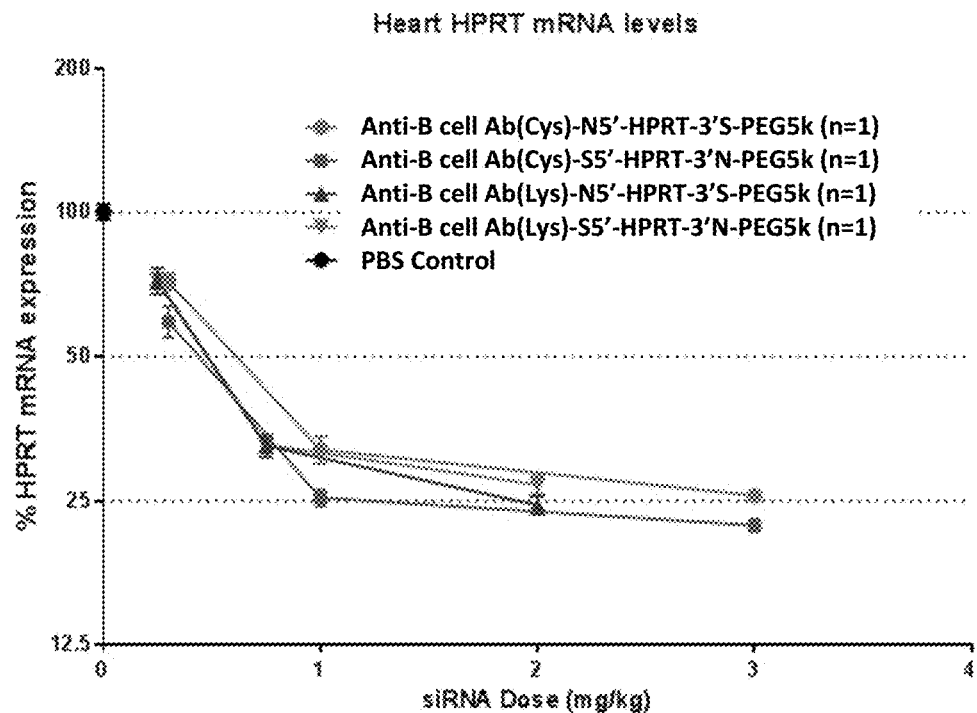
FIG. 76A-FIG. 76D illustrate mRNA expression levels of exemplary molecules described herein targeting HPRT. FIG.
Figure 76B:
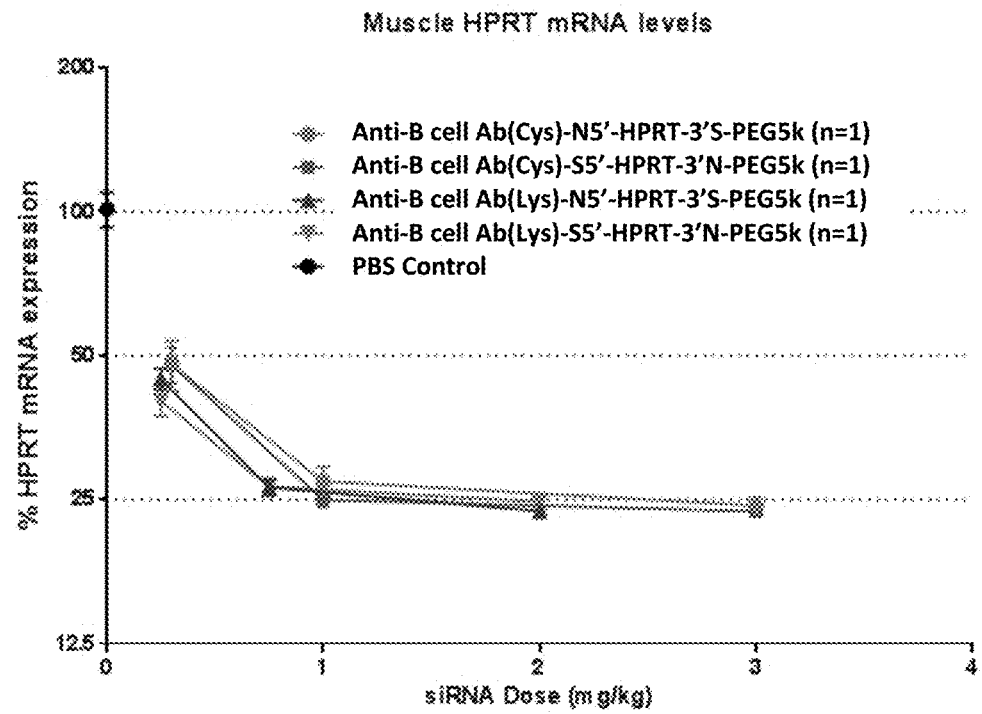
Figure 76C:
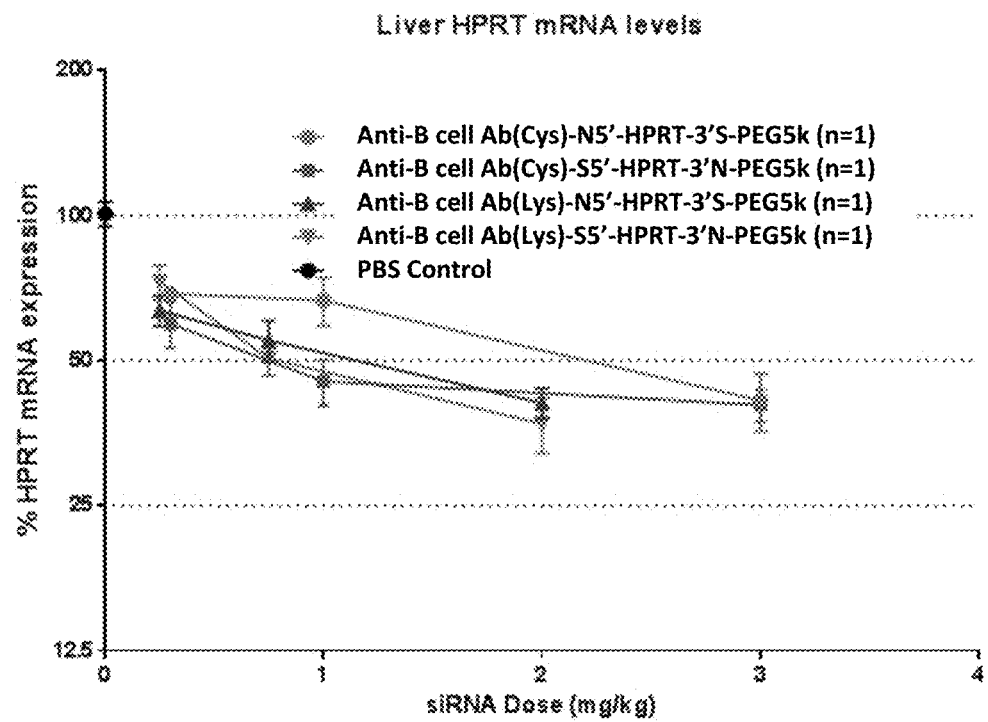
Figure 76D:
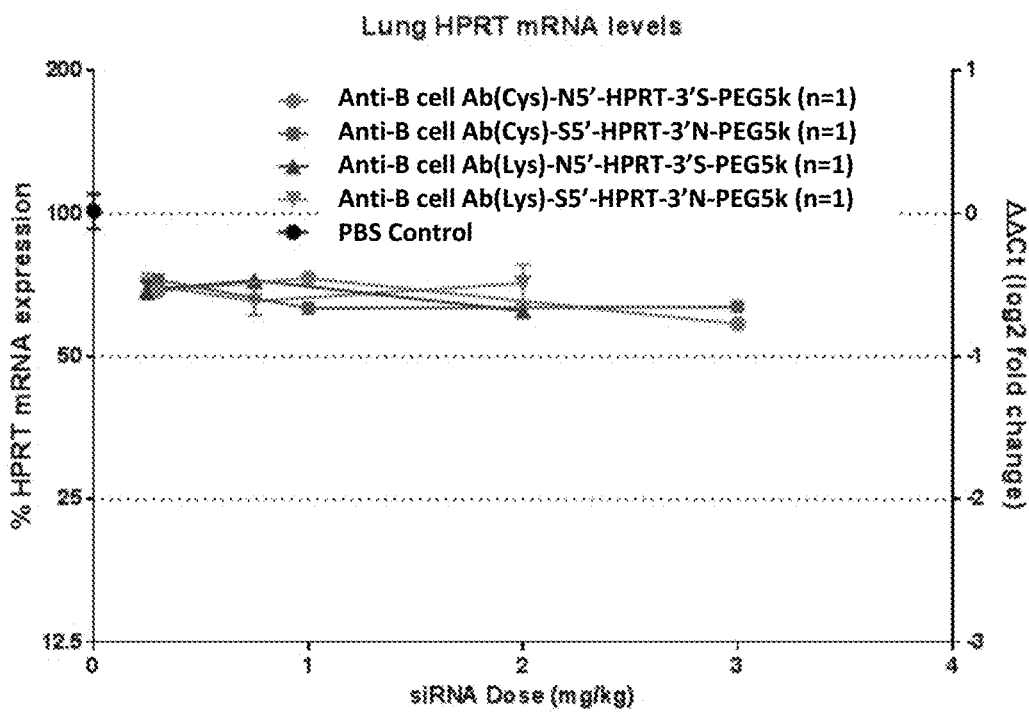
Figure 77B:
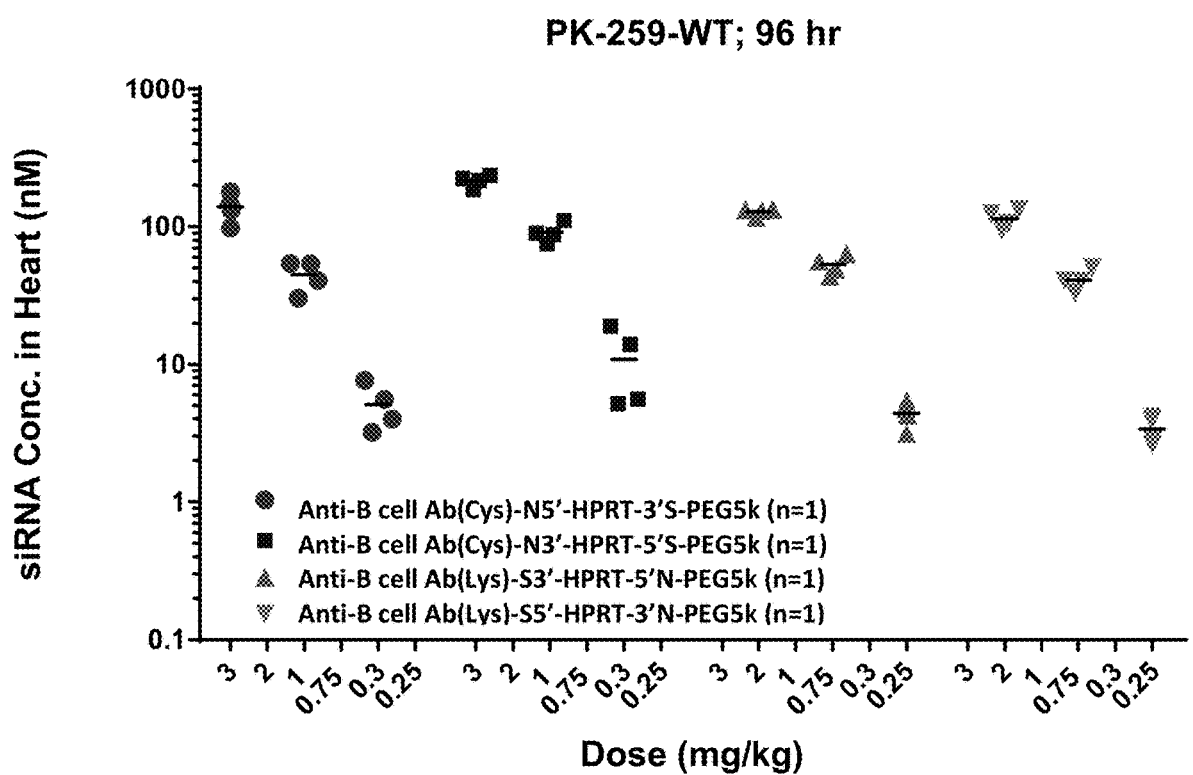
Figure 77C:
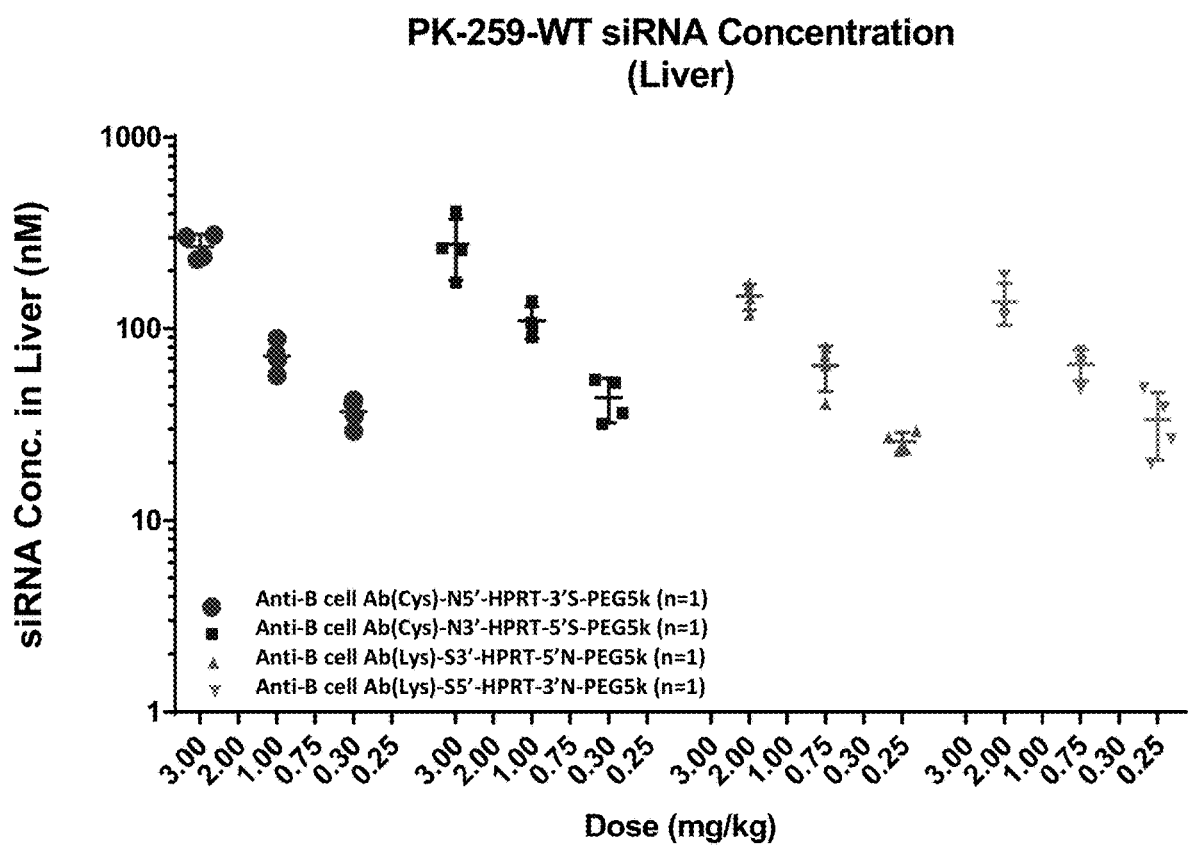
Figure 77D:
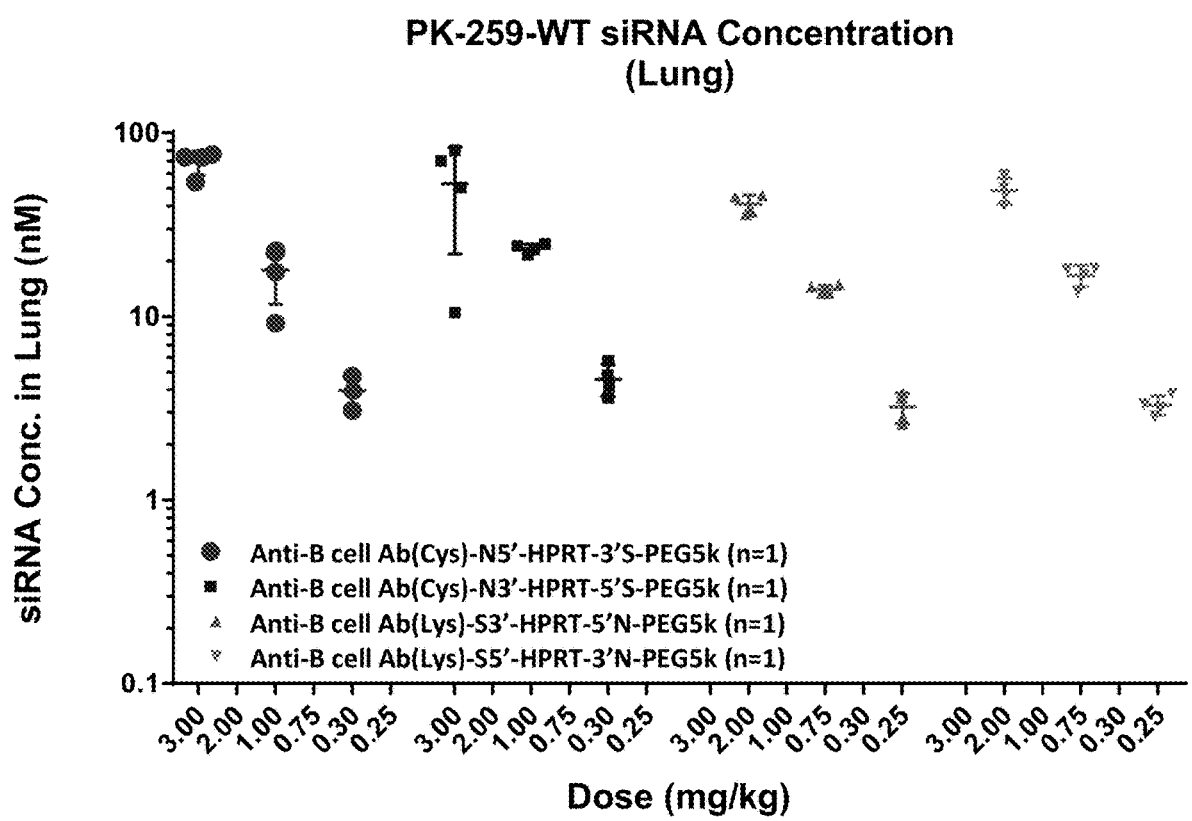
Figure 78A:
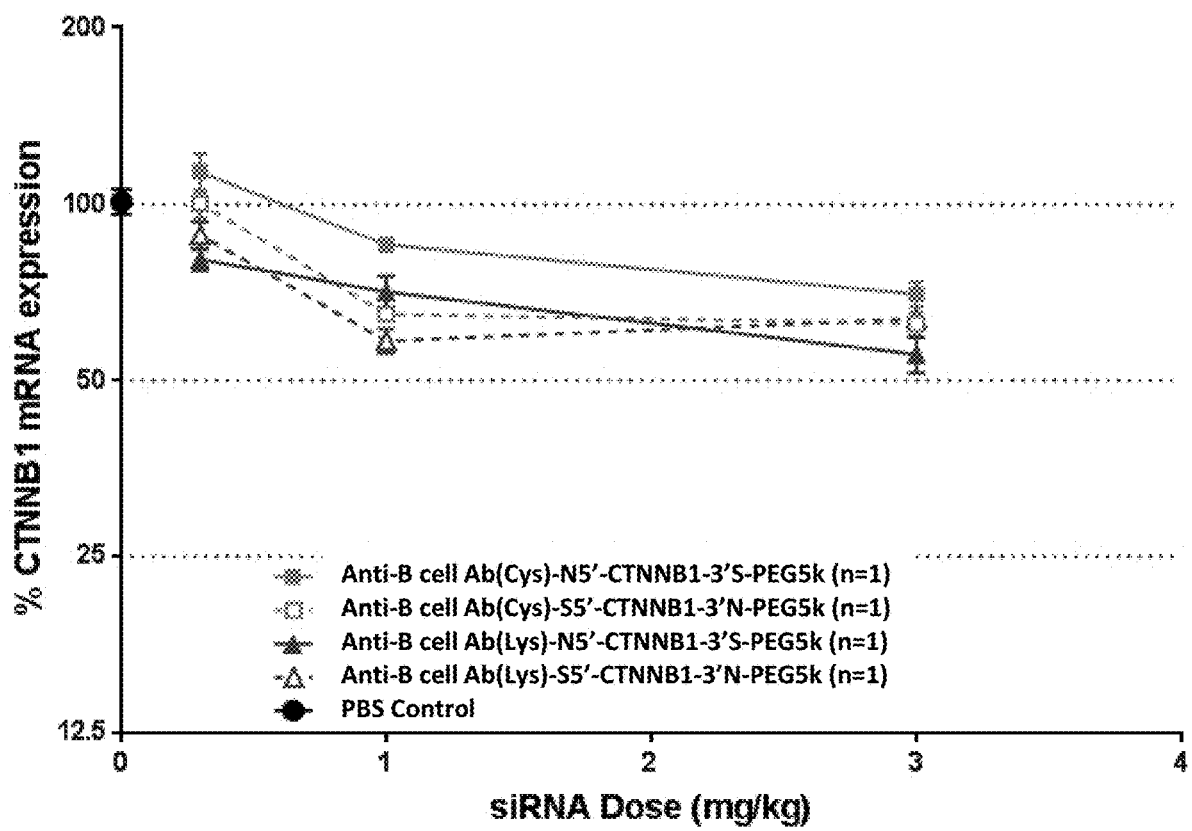
FIG. 78A-FIG. 78D illustrate mRNA expression levels of exemplary molecules encompassed by Formula (I) in heart (FIG. 78A), gastrointestinal tissue (FIG. 78B), liver (FIG. 78C), and lung (FIG. 78D) at 96 h post-treatment.
Figure 78B:
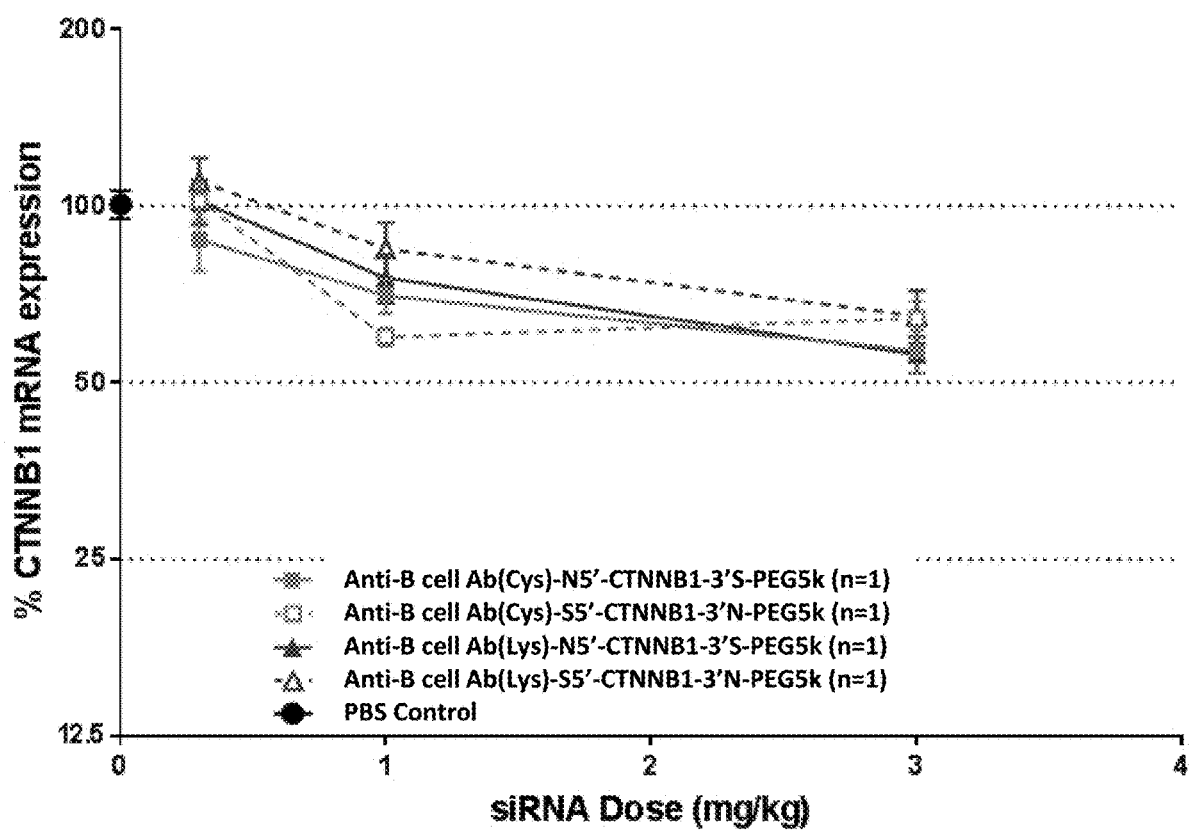
Figure 78C:
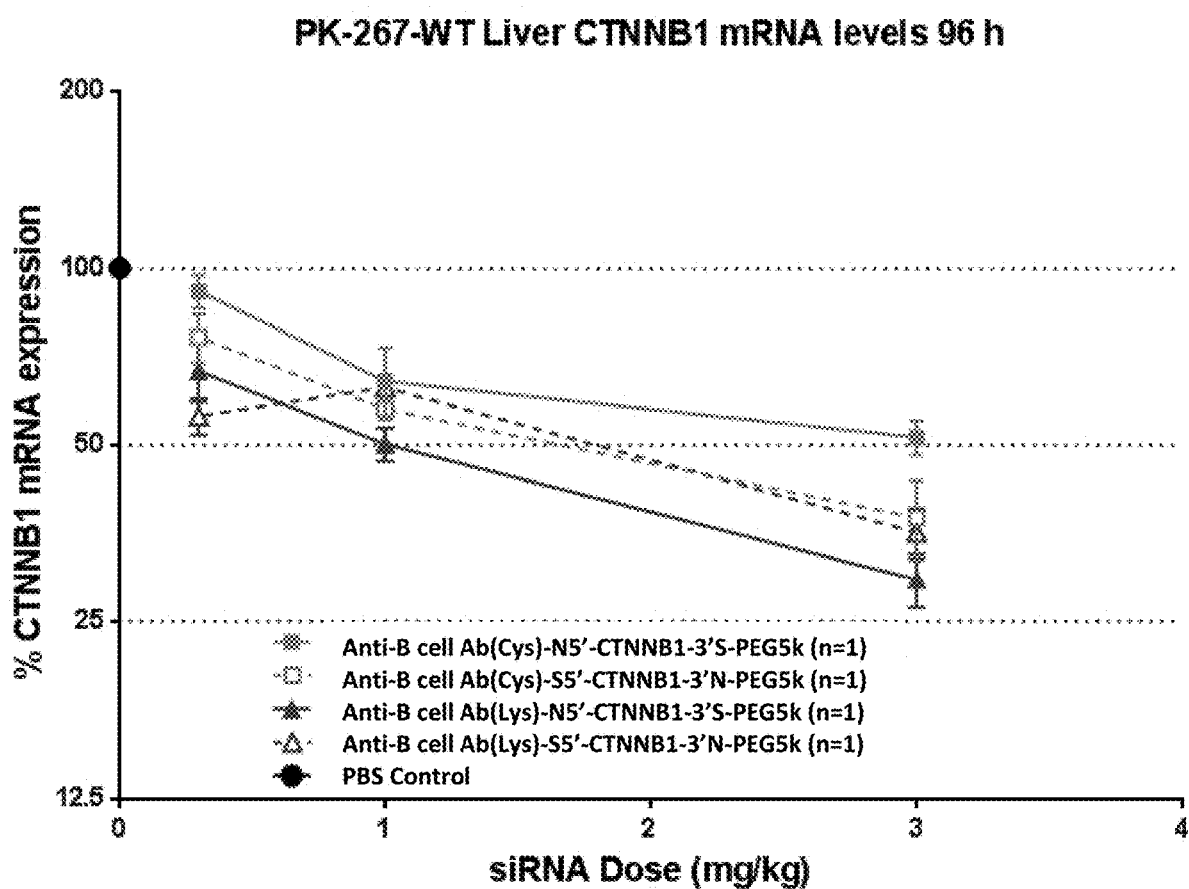
Figure 78D:
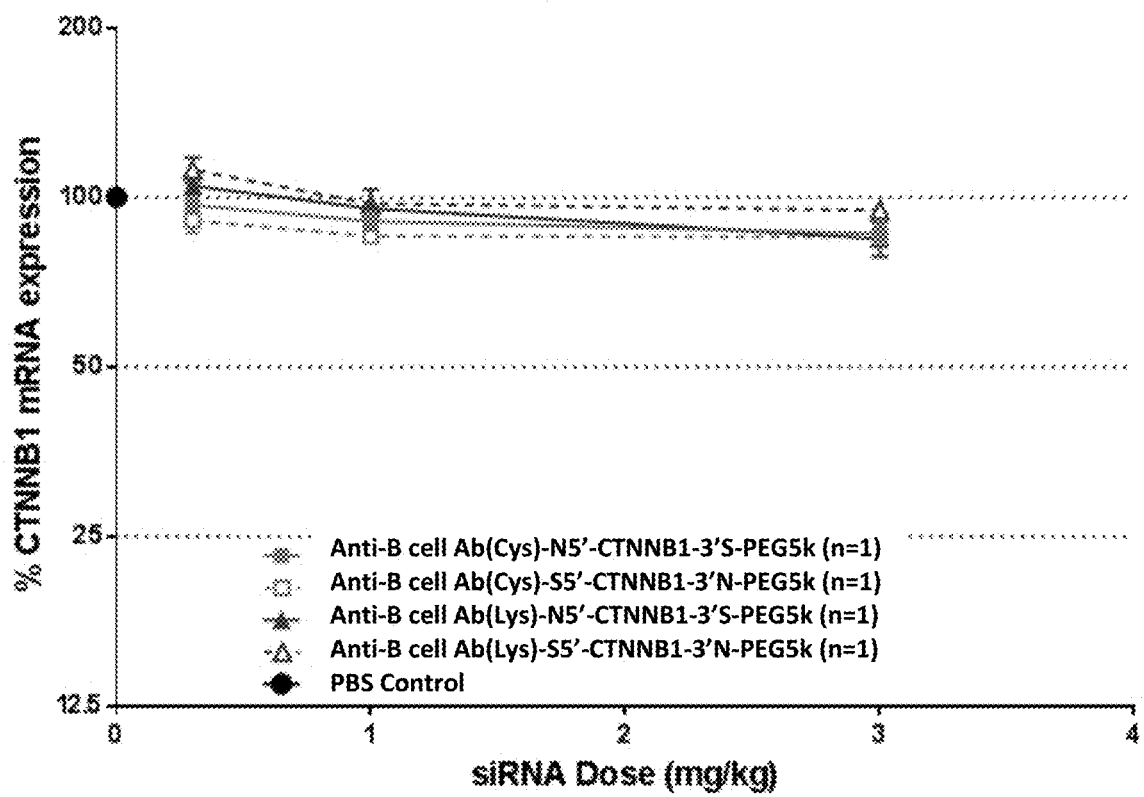

Groups (n=5) of female NCr nu/nu mice bearing subcutaneously (SC) flank HCC827 tumors 100-300 mm$^3$ in volume were treated with one intravenous (i.v.) tail vein injection of siRNA conjugate, while control group (n=5) of the same mice received one i.v. injection of PBS as a vehicle control. Table 45 describes the study design. Mice were sacrificed by CO$_2$ asphyxiation at 72, 96, and 168 hours post-dose. 50 mg pieces of tumor and liver, were collected and snap-frozen in liquid nitrogen. mRNA knockdown in target tissue was determined using a comparative qPCR assay as described in Example 2. Total RNA was extracted from the tissue, reverse transcribed and mRNA levels were quantified using TaqMan qPCR, using the appropriately designed primers and probes. PPIB (housekeeping gene) was used as an internal RNA loading control, results were calculated by the comparative Ct method, where the difference between the target gene Ct value and the PPIB Ct value ($\Delta$Ct) is calculated and then further normalized relative to the PBS control group by taking a second difference ($\Delta\Delta$Ct). Quantitation of tissue and plasma siRNA concentrations In this in vivo PK study the biological outcome of changes in the orientation of the conjugation site of the antibody and PEG (5' or 3') onto the siRNA were evaluated. In addition, the biological outcome of using a lysine or cysteine to attach the linker to the antibody was evaluated As illustrated FIG. 75A, both orientations of siRNA produced comparable EGFR tumor knockdown. As illustrated FIG. 75B and FIG. 75C, both orientations produced comparable siRNA tissue accumulation in the tumor and liver. As illustrated in FIG. 75D, both orientations produce a comparable plasma clearance kinetics.

As highlighted in FIG. 54, it was demonstrated biological activity with the A-X-B—Y-C conjugate with a range of different antibodies and siRNA cargos that are capable of in vivo biological activity in a range of different tissue targets. In this example, it was demonstrated that the antibody can be conjugated onto the 5' and 3' ends of the passenger strand of the siRNA and while maintaining the biological activity of the EGFR siRNA and tissue distribution.

Example 34: 2016-PK-259-WT siRNA Design and Synthesis

HPRT: A 21mer duplex with 19 bases of complementarity and 3' dinucleotide overhangs was designed against human HPRT. The sequence of the guide/antisense strand was complementary to the gene sequence starting a base position 425 for the human mRNA transcript for HPRT (guide strand sequence: UUAAAAUCUACAGUCAUAGUU; SEQ ID NO: 2104). Base, sugar and phosphate modifications were used to optimize the potency of the duplex and reduce immunogenicity. All siRNA single strands were fully assembled on solid phase using standard phosphoramidite chemistry and purified over HPLC. Purified single strands were duplexed to get the double stranded siRNA. Two different passenger strands were made containing two conjugation handles (C6-NH2 and C6-SH) in two different orientations (S5'-HPRT-3'N and N5'-HPRT-3'S). Both conjugation handles were connected to siRNA passenger strand via phosphodiester-inverted abasic-phosphorothioate linker. The C6-NH2 and C6-SH were connected through the phosphodiester, see Example 9 for the chemical structure.

ASC Synthesis and Characterization

The conjugate for groups 1-3 was made and purified as a DAR1 (n=1) using ASC architecture-4, as described in Example 9. The conjugate for groups 4-6 was made and purified as a DAR1 (n=1) using ASC architecture-2, as described in Example 9. The conjugate for groups 7-9 was made and purified as a DAR1 (n=1) using ASC architecture-1, as described in Example 9. The conjugate for groups 10-12 was made and purified as a DAR1 (n=1) using ASC architecture-3, as described in Example 9.

In Vivo Study Design

Groups (n=4) of wild-type female CD-1 mice were treated with one intravenous (i.v.) tail vein injections of siRNA conjugates, while the control group (n=5) of the same mice received one i.v. injection of PBS as a vehicle control. Table 46 illustrates the study design in more detail. 50 mg pieces of tissue, were collected and snap-frozen in liquid nitrogen. mRNA knockdown in target tissue was determined using a comparative qPCR assay as described in Example 2. Total RNA was extracted from the tissue, reverse transcribed and mRNA levels were quantified using TaqMan qPCR, using the appropriately designed primers and probes. PPIB (housekeeping gene) was used as an internal RNA loading control, results were calculated by the comparative Ct method, where the difference between the target gene Ct value and the PPIB Ct value ($\Delta$Ct) is calculated and then further normalized relative to the PBS control group by taking a second difference ($\Delta\Delta$Ct). Quantitation of tissue siRNA concentrations were determined using a stem-loop qPCR assay as described in Example 2. The antisense strand of the siRNA was reverse transcribed using a TaqMan MicroRNA reverse transcription kit using a sequence-specific stem-loop RT primer. The cDNA from the RT step was then utilized for real-time PCR and Ct values were transformed into plasma or tissue concentrations using the linear equations derived from the standard curves.

the biological outcome of using a lysine or cysteine to attach the linker to the antibody was evaluated. As illustrated in FIG. 76A-FIG. 76D, all the combinations of making the antibody conjugates produced comparable HPRT knockdown in the four tissue compartments measured. As illustrated in FIG. 77A-FIG. 77D, all the combinations of making the antibody conjugates produced comparable siRNA tissue accumulation in the different compartments measured.

In this example, it was demonstrated that a variety of different conjugation strategies to the siRNA and antibody can be used in the A-X-B—Y-C format while maintaining the biological activity of the HPRT siRNA and tissue distribution.

Example 35: 2016-PK-267-WT siRNA Design and Synthesis

CTNNB1: A 21mer duplex with 19 bases of complementarity and 3' dinucleotide overhangs was designed against human CTNNB1. The sequence of the guide/antisense strand was complementary to the gene sequence starting a base position 1797 for the human mRNA transcript for CTNNB1 (guide strand sequence: UUUCGAAUCAAUC-CAACAGUU; SEQ ID NO: 2098). Base, sugar and phosphate modifications were used to optimize the potency of the duplex and reduce immunogenicity. All siRNA single strands were fully assembled on solid phase using standard phosphoramidite chemistry and purified over HPLC. Purified single strands were duplexed to get the double stranded siRNA.

Two different passenger strands were made containing two conjugation handles (C6-NH$_2$ and C6-SH) in two different orientations (S5'-CTNNB1-3'N and N5'-CTNNB1-3'S). Both conjugation handles were connected to siRNA passenger strand via phosphodiester-inverted abasic-phosphorothioate linker. The C6-NH2 and C6-SH were connected through the phosphodiester, see Example 9 for the chemical structure.

ASC Synthesis and Characterization

The conjugate for groups 1-3 was made and purified as a DAR1 (n=1) using ASC architecture-4, as described in Example 9. The conjugate for groups 4-6 was made and purified as a DAR1 (n=1) using ASC architecture-3, as

TABLE 46

| Group | Test Article | N | siRNA Dose (mg/kg) | ROA | Dose Volume (mL/kg) | # of Doses | Harvest Time (h) |
|---|---|---|---|---|---|---|---|
| 1 | Anti-B cell Ab(Cys)-N5'-HPRT-3'S-PEG5k (n = 1) | 4 | 3 | IV | 5.0 | 1 | 96 |
| 2 | Anti-B cell Ab(Cys)-N5'-HPRT-3'S-PEG5k (n = 1) | 4 | 1 | IV | 5.0 | 1 | 96 |
| 3 | Anti-B cell Ab(Cys)-N5'-HPRT-3'S-PEG5k (n = 1) | 4 | 0.3 | IV | 5.0 | 1 | 96 |
| 4 | Anti-B cell Ab(Cys)-N3'-HPRT-5'S-PEG5k (n = 1) | 4 | 3 | IV | 5.0 | 1 | 96 |
| 5 | Anti-B cell Ab(Cys)-N3'-HPRT-5'S-PEG5k (n = 1) | 4 | 1 | IV | 5.0 | 1 | 96 |
| 6 | Anti-B cell Ab(Cys)-N3'-HPRT-5'S-PEG5k (n = 1) | 4 | 0.3 | IV | 5.0 | 1 | 96 |
| 7 | Anti-B cell Ab(Lys)-S3'-HPRT-5'N-PEG5k (n = 1) | 4 | 2 | IV | 5.0 | 1 | 96 |
| 8 | Anti-B cell Ab(Lys)-S3'-HPRT-5'N-PEG5k (n = 1) | 4 | 0.75 | IV | 5.0 | 1 | 96 |
| 9 | Anti-B cell Ab(Lys)-S3'-HPRT-5'N-PEG5k (n = 1) | 4 | 0.25 | IV | 5.0 | 1 | 96 |
| 10 | Anti-B cell Ab(Lys)-S5'-HPRT-3'N-PEG5k (n = 1) | 4 | 2 | IV | 5.0 | 1 | 96 |
| 11 | Anti-B cell Ab(Lys)-S5'-HPRT-3'N-PEG5k (n = 1) | 4 | 0.75 | IV | 5.0 | 1 | 96 |
| 12 | Anti-B cell Ab(Lys)-S5'-HPRT-3'N-PEG5k (n = 1) | 4 | 0.25 | IV | 5.0 | 1 | 96 |
| 13 | PBS Control | 5 | — | IV | 5.0 | 1 | 96 |
| | Total # of Animals: | 53 | | WT mice (CD-1) | | | |

In the in vivo PK study the biological outcome of changes in the orientation of the conjugation site of the antibody and PEG (5' or 3') onto the siRNA were evaluated. In addition, described in Example 9. The conjugate for groups 7-9 was made and purified as a DAR1 (n=1) using ASC architecture-2, as described in Example 9. The conjugate for groups 10-12 was made and purified as a DAR1 (n=1) using ASC architecture-1, as described in Example 9.

In Vivo Study Design

Groups (n=4) of wild-type female CD-1 mice were treated with one intravenous (i.v.) tail vein injections of siRNA conjugates, while the control group (n=5) of the same mice received one i.v. injection of PBS as a vehicle control. Table 47 illustrates the study design in more detail. 50 mg pieces of tissue, were collected and snap-frozen in liquid nitrogen. mRNA knockdown in target tissue was determined using a comparative qPCR assay as described in Example 2. Total RNA was extracted from the tissue, reverse transcribed and mRNA levels were quantified using TaqMan qPCR, using the appropriately designed primers and probes. PPIB (housekeeping gene) was used as an internal RNA loading control, results were calculated by the comparative Ct method, where the difference between the target gene Ct value and the PPIB Ct value ($\Delta$Ct) is calculated and then further normalized relative to the PBS control group by taking a second difference ($\Delta\Delta$Ct).

complementary to the gene sequence starting a base position 333 for the human mRNA transcript for EGFR (ACUCGUGCCUUGGCAAACUUU; SEQ ID NO: 2082). Base, sugar and phosphate modifications were used to optimize the potency of the duplex and reduce immunogenicity. All siRNA single strands were fully assembled on solid phase using standard phospharamidite chemistry and purified over HPLC. Purified single strands were duplexed to get the double stranded siRNA. The passenger strand contained two conjugation handles, a C6-NH2 at the 5' end and a C6-SH at the 3' end. Both conjugation handles were connected to siRNA passenger strand via phosphorothioate-inverted abasic-phosphorothioate linker, see Example 9 for the chemical structure.

ASC Synthesis and Characterization

All conjugates were made and purified as a DAR1 (n=1) using ASC architecture-4, as described in Example 9.

In Vivo Study Design

Groups (n=4) of wild-type female CD-1 mice were treated with one intravenous (i.v.) tail vein injections of siRNA

TABLE 47

| Group | Test Article | N | siRNA Dose (mg/kg) | ROA | Dose Volume (mL/kg) | # of Doses | Harvest Time (h) |
|---|---|---|---|---|---|---|---|
| 1 | Anti-B cell Ab(Cys)-N5'-CTNNB1-3'S-PEG5k (n = 1) | 4 | 3 | IV | 5.0 | 1 | 96 |
| 2 | Anti-B cell Ab(Cys)-N5'-CTNNB1-3'S-PEG5k (n = 1) | 4 | 1 | IV | 5.0 | 1 | 96 |
| 3 | Anti-B cell Ab(Cys)-N5'-CTNNB1-3'S-PEG5k (n = 1) | 4 | 0.3 | IV | 5.0 | 1 | 96 |
| 4 | Anti-B cell Ab(Lys)-S5'-CTNNB1-3'N-PEG5k (n = 1) | 4 | 3 | IV | 5.0 | 1 | 96 |
| 5 | Anti-B cell Ab(Lys)-S5'-CTNNB1-3'N-PEG5k (n = 1) | 4 | 1 | IV | 5.0 | 1 | 96 |
| 6 | Anti-B cell Ab(Lys)-S5'-CTNNB1-3'N-PEG5k (n = 1) | 4 | 0.3 | IV | 5.0 | 1 | 96 |
| 7 | Anti-B cell Ab(Cys)-N3'-CTNNB1-5'S-PEG5k (n = 1) | 4 | 3 | IV | 5.0 | 1 | 96 |
| 8 | Anti-B cell Ab(Cys)-N3'-CTNNB1-5'S-PEG5k (n = 1) | 4 | 1 | IV | 5.0 | 1 | 96 |
| 9 | Anti-B cellAb(Cys)-N3'-CTNNB1-5'S-PEG5k (n = 1) | 4 | 0.3 | IV | 5.0 | 1 | 96 |
| 10 | Anti-B cell Ab(Lys)-S3'-CTNNB1-5'N-PEG5k (n = 1) | 4 | 3 | IV | 5.0 | 1 | 96 |
| 11 | Anti-B cell Ab(Lys)-S3'-CTNNB1-5'N-PEG5k (n = 1) | 4 | 1 | IV | 5.0 | 1 | 96 |
| 12 | Anti-B cell Ab(Lys)-S3'-CTNNB1-5'N-PEG5k (n = 1) | 4 | 0.3 | IV | 5.0 | 1 | 96 |
| 13 | PBS Control | 5 | — | IV | 5.0 | 1 | 96 |
| | Total # of Animals: | 53 | | WT mice (CD-1) | | | |

In this in vivo PK study, the biological outcome of changes in the orientation of the conjugation site of the antibody and PEG (5' or 3') onto the siRNA and the biological outcome of using a lysine or cysteine to attach the linker to the antibody were evaluated. As illustrated in FIG. 78A-FIG. 78D, all the combinations of making the antibody conjugates produced comparable CTNNB1 knockdown in the four tissue compartments measured.

In this example, it was demonstrated that a variety of different conjugation strategies to the siRNA and antibody can be used in the A-X-B—Y-C format while maintaining the biological activity of the CTNNB1 siRNA.

Example 36: 2016-PK-188-PK

EFGR: A 21mer duplex with 19 bases of complementarity and 3' dinucleotide overhangs was designed against human EGFR. The sequence of the guide/antisense strand was conjugates. Treatment groups received 0.5 mg/kg (based on the weight of siRNA) and all groups were administered a dose volume of 5.0 mL/kg. Table 48 illustrates the study design in more detail. Non-terminal blood samples were collected at 5, 30, and 180 minutes post-dose via puncture of the retro-orbital plexus and centrifuged to generate plasma for PK analysis. Mice were sacrificed by $CO_2$ asphyxiation at 24, 96, or 168 h post-dose. Terminal blood samples were collected via cardiac puncture and processed to generate plasma for PK analysis. Quantitation of plasma siRNA concentrations were determined using a stem-loop qPCR assay as described in Example 2. The antisense strand of the siRNA was reverse transcribed using a TaqMan MicroRNA reverse transcription kit using a sequence-specific stem-loop RT primer. The cDNA from the RT step was then utilized for real-time PCR and Ct values were transformed into plasma or tissue concentrations using the linear equations derived from the standard curves.

TABLE 48

| Gr | Test Article | N | ROA | Dose Volume (mL/kg) | # of Doses | Survival Bleed (min) | Terminal Bleed (h) |
|---|---|---|---|---|---|---|---|
| 1 | EGFR-Ab(Cys)-EGFR-PEG5k (n = 1) | 4 | IV | 5.0 | 1 | 5 | 24 |
| 2 | | 4 | IV | 5.0 | 1 | 30 | 96 |
| 3 | | 4 | IV | 5.0 | 1 | 180 | 168 |
| 4 | EGFR-Ab(Cys)-ECL-EGFR-PEG5k (n = 1) | 4 | IV | 5.0 | 1 | 5 | 24 |
| 5 | | 4 | IV | 5.0 | 1 | 30 | 96 |
| 6 | | 4 | IV | 5.0 | 1 | 180 | 168 |
| 7 | EGFR-Ab(Cys)-EGFR-SS-PEG5k (n = 1) | 4 | IV | 5.0 | 1 | 5 | 24 |
| 8 | | 4 | IV | 5.0 | 1 | 30 | 96 |
| 9 | | 4 | IV | 5.0 | 1 | 180 | 168 |
| 10 | EGFR-Ab(Cys)-ECL-EGFR-SS-PEG5k (n = 1) | 4 | IV | 5.0 | 1 | 5 | 24 |
| 11 | | 4 | IV | 5.0 | 1 | 30 | 96 |
| 12 | | 4 | IV | 5.0 | 1 | 180 | 168 |
| | Total # of Animals: | 48 | | | WT mice CD-1 | | |

Figure 79:
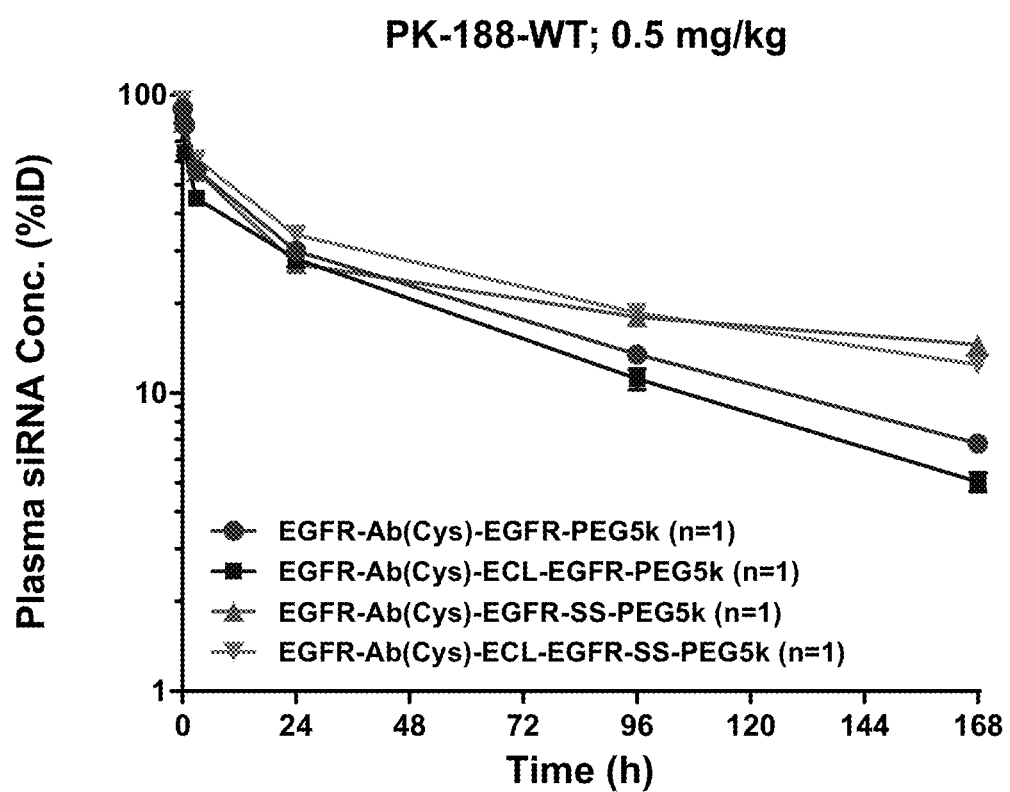
FIG. 79 illustrates plasma siRNA concentration of exemplary molecules encompassed by Formula (I).

As illustrated in FIG. 79, all the ASC with the different cleavable linker configurations achieved equivalent plasma PK profiles, with approximately 10% of the siRNA remaining 168 hours after administration.

In this example, it was demonstrated biological activity with a range of A-X-B—Y-C conjugates in which a variety of different linker strategies (component X and Y) were used to conjugate the PEG and antibody to the siRNA passenger strand.

Example 37: 2016-PK-201-LNCaP siRNA Design and Synthesis

EFGR: A 21mer duplex with 19 bases of complementarity and 3' dinucleotide overhangs was designed against human EGFR. The sequence of the guide/antisense strand was complementary to the gene sequence starting a base position 333 for the human mRNA transcript for EGFR (ACUCGUGCCUUGGCAAACUUU; SEQ ID NO: 2082). Base, sugar and phosphate modifications were used to optimize the potency of the duplex and reduce immunogenicity. All siRNA single strands were fully assembled on solid phase using standard phosphoramidite chemistry and purified over HPLC. Purified single strands were duplexed to get the double stranded siRNA. The passenger strand contained two conjugation handles, a C6-NH2 at the 5' end and a C6-SH at the 3' end. Both conjugation handles were connected to siRNA passenger strand via phosphorothioate-inverted abasic-phosphorothioate linker, see Example 9 for the chemical structure.

Negative control siRNA sequence (scramble): A published (Burke et al. (2014) Pharm. Res., 31(12):3445-60) 21mer duplex with 19 bases of complementarity and 3' dinucleotide overhangs was used. The sequence (5' to 3') of the guide/antisense strand was UAUCGACGUGUCCAGC-UAGUU (SEQ ID NO: 2116). Base, sugar and phosphate modifications were used to reduce immunogenicity and were comparable to those used in the active siRNA. All siRNA single strands were fully assembled on solid phase using standard phosphoramidite chemistry and purified over HPLC. Purified single strands were duplexed to get the double stranded siRNA. The passenger strand contained two conjugation handles, a C6-NH2 at the 5' end and a C6-SH at the 3' end. Both conjugation handles were connected to siRNA passenger strand via a phosphodiester-inverted abasic-phosphodiester linker, see Example 9 for the chemical structure.

ASC Synthesis and Characterization

All conjugates were made and purified as a DAR1 (n=1) using ASC architecture-4, as described in Example 9.

In Vivo Study Design

Groups 1-7 (n=5) of female SCID SHO mice bearing subcutaneous flank LNCaP tumors 100-350 mm$^3$ in volume were treated with one intravenous (i.v.) tail vein injection of siRNA conjugate, while control group 8 (n=5) of the same mice received one i.v. injection of PBS as a vehicle control. Table 49 describes the study design. Mice were sacrificed by $CO_2$ asphyxiation at 96 hours post-dose. 50 mg pieces of tumor and liver, were collected and snap-frozen in liquid nitrogen. mRNA knockdown in target tissue was determined using a comparative qPCR assay as described in Example 2. Total RNA was extracted from the tissue, reverse transcribed and mRNA levels were quantified using TaqMan qPCR, using the appropriately designed primers and probes. PPIB (housekeeping gene) was used as an internal RNA loading control, results were calculated by the comparative Ct method, where the difference between the target gene Ct value and the PPIB Ct value ($\Delta$Ct) is calculated and then further normalized relative to the PBS control group by taking a second difference ($\Delta\Delta$Ct). Quantitation of tissue siRNA concentrations were determined using a stem-loop qPCR assay as described in Example 2. The antisense strand of the siRNA was reverse transcribed using a TaqMan MicroRNA reverse transcription kit using a sequence-specific stem-loop RT primer. The cDNA from the RT step was then utilized for real-time PCR and Ct values were transformed into plasma or tissue concentrations using the linear equations derived from the standard curves.

TABLE 49

| Group | Test Article | N | siRNA Dose (mg/kg) | ROA | Dose Volume (mL/kg) | # of Doses | Harvest Time (h) |
|---|---|---|---|---|---|---|---|
| 1 | PSMA-Ab(Cys)-EGFR-SS-PEG5k (n = 1) | 5 | 1 | IV | 5.0 | 1 | 96 |
| 2 | PSMA-Ab(Cys)-EGFR-SS-PEG5k (n = 1) | 5 | 0.5 | IV | 5.0 | 1 | 96 |
| 3 | PSMA-Ab(Cys)-EGFR-ECL-PEG5k (n = 1) | 5 | 1 | IV | 5.0 | 1 | 96 |

TABLE 49-continued

| Group | Test Article | N | siRNA Dose (mg/kg) | ROA | Dose Volume (mL/kg) | # of Doses | Harvest Time (h) |
|---|---|---|---|---|---|---|---|
| 4 | PSMA-Ab(Cys)-EGFR-ECL-PEG5k (n = 1) | 5 | 0.5 | IV | 5.0 | 1 | 96 |
| 5 | PSAM-Ab(Cys)-EGFR-PEG5k (n = 1) | 5 | 1 | IV | 5.0 | 1 | 96 |
| 6 | PSAM-Ab(Cys)-EGFR-PEG5k (n = 1) | 5 | 0.5 | IV | 5.0 | 1 | 96 |
| 7 | PSMA-Ab(Cys)-scramble-PEG5k (n = 1) | 5 | 1 | IV | 5.0 | 1 | 96 |
| 8 | PBS Control | 5 | — | IV | 5.0 | 1 | 96 |
| | Total # of Animals: | 40 | SCID SHO mice with LNCaP tumors | | | | |

Figure 80A:
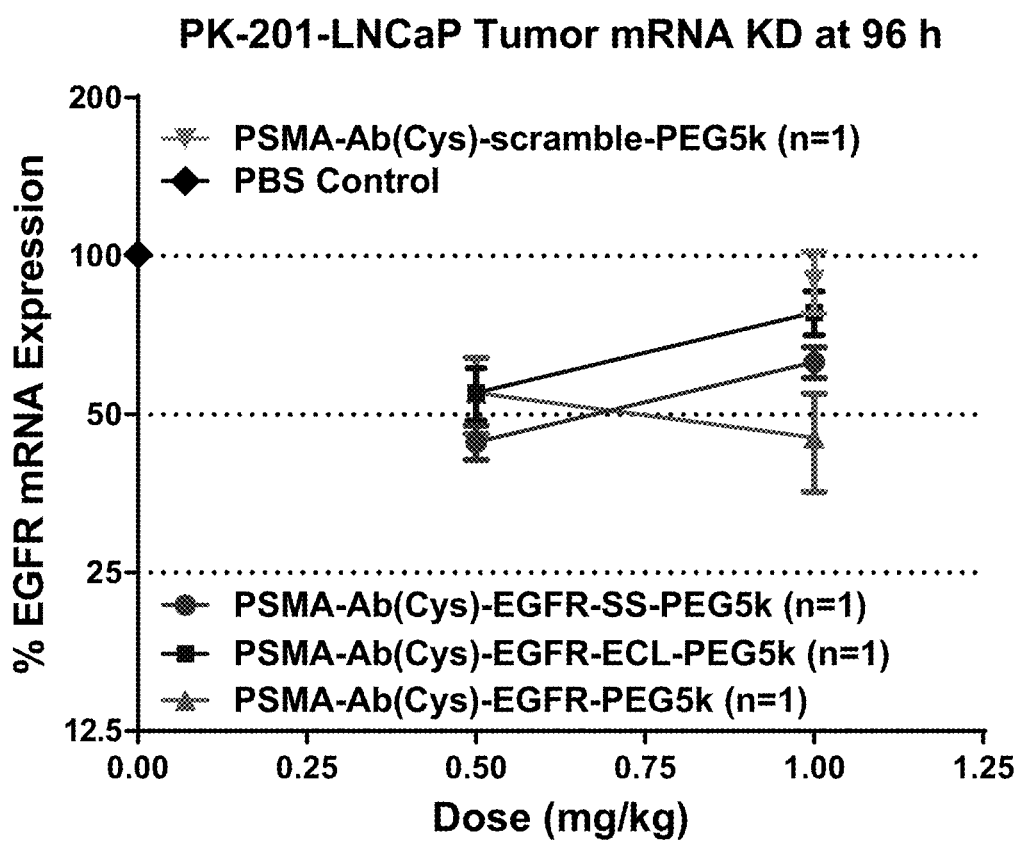
FIG. 80A shows mRNA expression level of exemplary molecules encompassed by Formula (I) in LNCaP tumor at 96 h post-treatment.
Figure 80B:
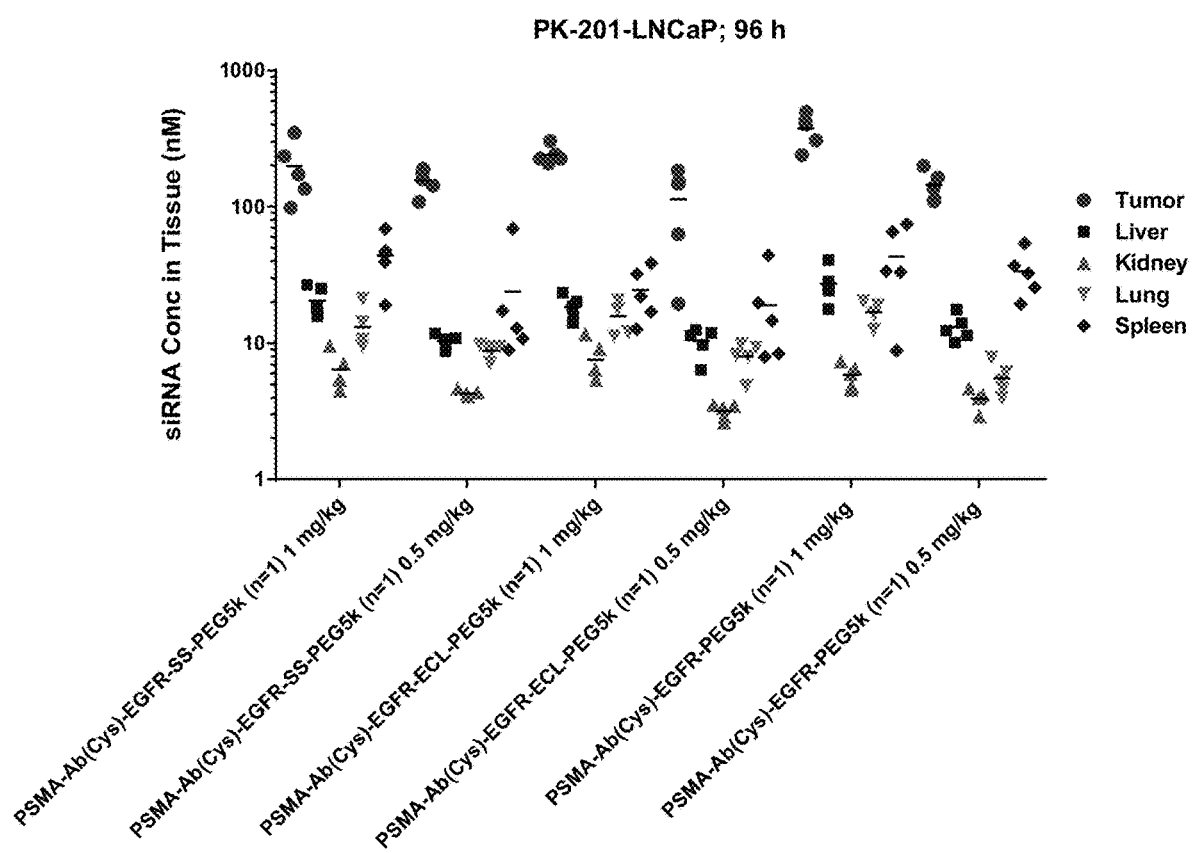
FIG. 80B shows siRNA concentration of exemplary molecules encompassed by Formula (I) in LNCaP tumor, liver, kidney, lung, and spleen tissue samples.

As illustrated in FIG. 80A, a variety of different linkers were used between the siRNA and PEG, after i.v administration of a single dose of siRNA measurable tumor tissue EGFR downregulation was achieved relative to the negative control siRNA sequence or PBS controls. In addition, as illustrated in FIG. 80B, the different linker configurations resulted in tumor siRNA accumulation at higher levels than the other tissue samples measured (liver, spleen, lung and kidney).

In this example, it was demonstrated biological activity with a range of A-X—B—Y—C conjugates in which a variety of different linkers strategies (component Y) were used to conjugate the PEG to the siRNA passenger strand.

Example 38: 2016-PK-198-HCC827 siRNA Design and Synthesis

EFGR: A 21mer duplex with 19 bases of complementarity and 3' dinucleotide overhangs was designed against human EGFR. The sequence of the guide/antisense strand was complementary to the gene sequence starting a base position 333 for the human mRNA transcript for EGFR (ACUCGUGCCUUGGCAAACUUU; SEQ ID NO: 2082). Base, sugar and phosphate modifications were used to optimize the potency of the duplex and reduce immunogenicity. All siRNA single strands were fully assembled on solid phase using standard phosphoramidite chemistry and purified over HPLC. Purified single strands were duplexed to get the double stranded siRNA. The passenger strand contained two conjugation handles, a C6-NH2 at the 5' end and a C6-SH at the 3' end. Both conjugation handles were connected to siRNA passenger strand via phosphorothioate-inverted abasic-phosphorothioate linker, see Example 9 for the chemical structure.

Negative control siRNA sequence (scramble): A published (Burke et al. (2014) Pharm. Res., 31(12):3445-60) 21 mer duplex with 19 bases of complementarity and 3' dinucleotide overhangs was used. The sequence (5' to 3') of the guide/antisense strand was UAUCGACGUGUCCAGC-UAGUU (SEQ ID NO: 2116). Base, sugar and phosphate modifications were used to reduce immunogenicity and were comparable to those used in the active siRNA. All siRNA single strands were fully assembled on solid phase using standard phosphoramidite chemistry and purified over HPLC. Purified single strands were duplexed to get the double stranded siRNA. The passenger strand contained two conjugation handles, a C6-NH2 at the 5' end and a C6-SH at the 3' end. Both conjugation handles were connected to siRNA passenger strand via a phosphodiester-inverted abasic-phosphodiester linker, see Example 9 for the chemical structure.

ASC Synthesis and Characterization

All conjugates were made and purified as a DAR1 (n=1) using ASC architecture-4, as described in Example 9.

In Vivo Study Design

Groups 1-15 (n=5) of female NCr nu/nu mice bearing subcutaneously (SC) flank HCC827 tumors 100-300 mm$^3$ in volume were treated with one intravenous (i.v.) tail vein injection of siRNA conjugate, while control group 16 (n=5) of the same mice received one i.v. injection of PBS as a vehicle control. Table 50 describes the study design. Mice were sacrificed by $CO_2$ asphyxiation at 96 hours post-dose. 50 mg pieces of tumor and liver, were collected and snap-frozen in liquid nitrogen. mRNA knockdown in target tissue was determined using a comparative qPCR assay as described in Example 2. Total RNA was extracted from the tissue, reverse transcribed and mRNA levels were quantified using TaqMan qPCR, using the appropriately designed primers and probes. PPIB (housekeeping gene) was used as an internal RNA loading control, results were calculated by the comparative Ct method, where the difference between the target gene Ct value and the PPIB Ct value ($\Delta$Ct) is calculated and then further normalized relative to the PBS control group by taking a second difference ($\Delta\Delta$Ct). Quantitation of tissue siRNA concentrations were determined using a stem-loop qPCR assay as described in Example 2. The antisense strand of the siRNA was reverse transcribed using a TaqMan MicroRNA reverse transcription kit using a sequence-specific stem-loop RT primer. The cDNA from the RT step was then utilized for real-time PCR and Ct values were transformed into plasma or tissue concentrations using the linear equations derived from the standard curves.

TABLE 50

| Group | Test Article | N | siRNA Dose (mg/kg) | ROA | Dose Volume (mL/kg) | # of Doses | Harvest Time (h) |
|---|---|---|---|---|---|---|---|
| 1 | EGFR-Ab(Cys)-EGFR-PEG2k (n = 1) | 5 | 1 | IV | 5.0 | 1 | 96 |
| 2 | EGFR-Ab(Cys)-EGFR-PEG2k (n = 1) | 5 | 0.5 | IV | 5.0 | 1 | 96 |
| 3 | EGFR-Ab(Cys)-EGFR-PEG2k (n = 1) | 5 | 0.25 | IV | 5.0 | 1 | 96 |
| 4 | EGFR-Ab(Cys)-EGFR-dPEG$_{48}$ (n = 1) | 5 | 1 | IV | 5.0 | 1 | 96 |
| 5 | EGFR-Ab(Cys)-EGFR-dPEG$_{48}$ (n = 1) | 5 | 0.5 | IV | 5.0 | 1 | 96 |
| 6 | EGFR-Ab(Cys)-EGFR-dPEG$_{48}$ (n = 1) | 5 | 0.25 | IV | 5.0 | 1 | 96 |
| 7 | EGFR-Ab(Cys)-EGFR-dPEG$_{24}$ (n = 1) | 5 | 1 | IV | 5.0 | 1 | 96 |
| 8 | EGFR-Ab(Cys)-EGFR-dPEG$_{24}$ (n = 1) | 5 | 0.5 | IV | 5.0 | 1 | 96 |

TABLE 50-continued

| Group | Test Article | N | siRNA Dose (mg/kg) | ROA | Dose Volume (mL/kg) | # of Doses | Harvest Time (h) |
|---|---|---|---|---|---|---|---|
| 9 | EGFR-Ab(Cys)-EGFR-dPEG$_{24}$ (n = 1) | 5 | 0.25 | IV | 5.0 | 1 | 96 |
| 10 | EGFR-Ab(Cys)-EGFR-dPEG$_{12}$ (n = 1) | 5 | 1 | IV | 5.0 | 1 | 96 |
| 11 | EGFR-Ab(Cys)-EGFR-dPEG$_{12}$ (n = 1) | 5 | 0.5 | IV | 5.0 | 1 | 96 |
| 12 | EGFR-Ab(Cys)-EGFR-dPEG$_{12}$ (n = 1) | 5 | 0.25 | IV | 5.0 | 1 | 96 |
| 13 | EGFR-Ab(Cys)-EGFR-PEG5k (n = 1) | 5 | 1 | IV | 5.0 | 1 | 96 |
| 14 | PSMA-Ab(Cys)-EGFR-PEG5k (n = 1) | 5 | 1 | IV | 5.0 | 1 | 96 |
| 15 | EGFR-Ab(Cys)-scramble-PEG5k (n = 1) | 5 | 1 | IV | 5.0 | 1 | 96 |
| 16 | PBS Control | 5 | — | IV | 5.0 | 1 | 96 |
| | Total # of Animals: | 80 | nu/nu mice with HCC827 tumors | | | | |

Figure 81A:
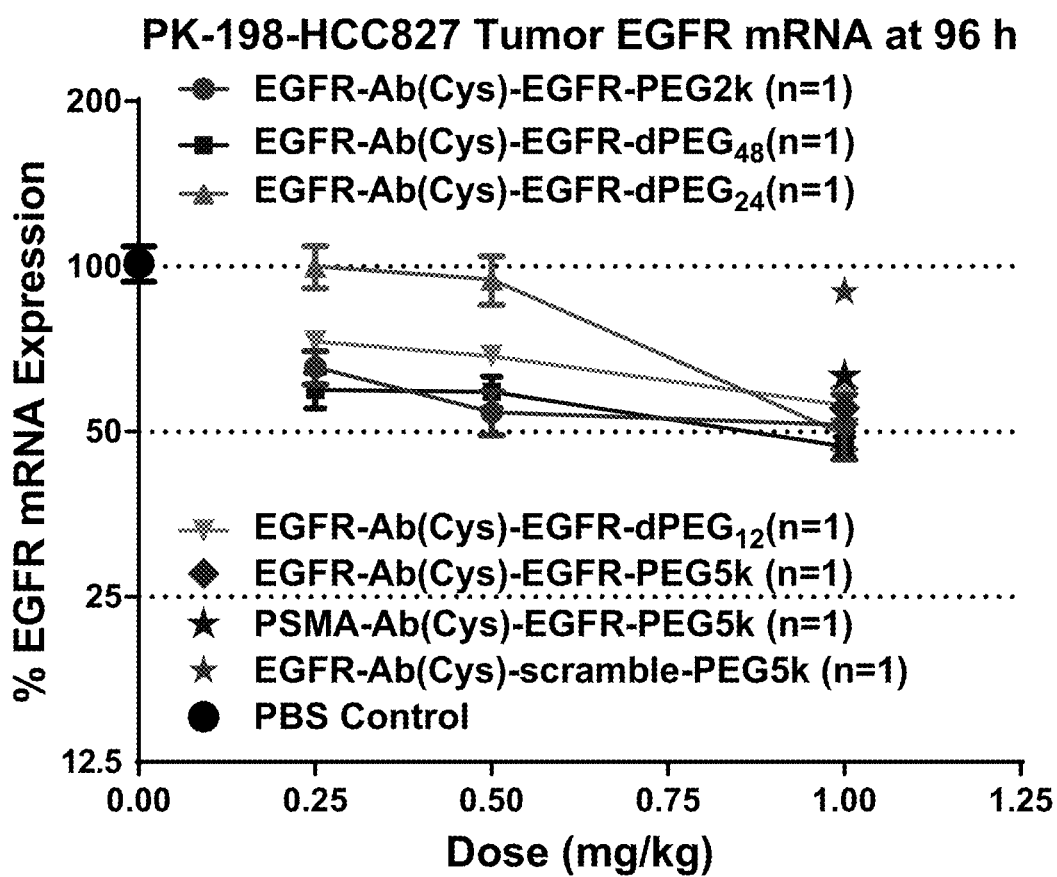
FIG. 81A shows mRNA expression level of exemplary molecules encompassed by Formula (I) in HCC827 tumor at 96 h post-treatment.
Figure 81B:
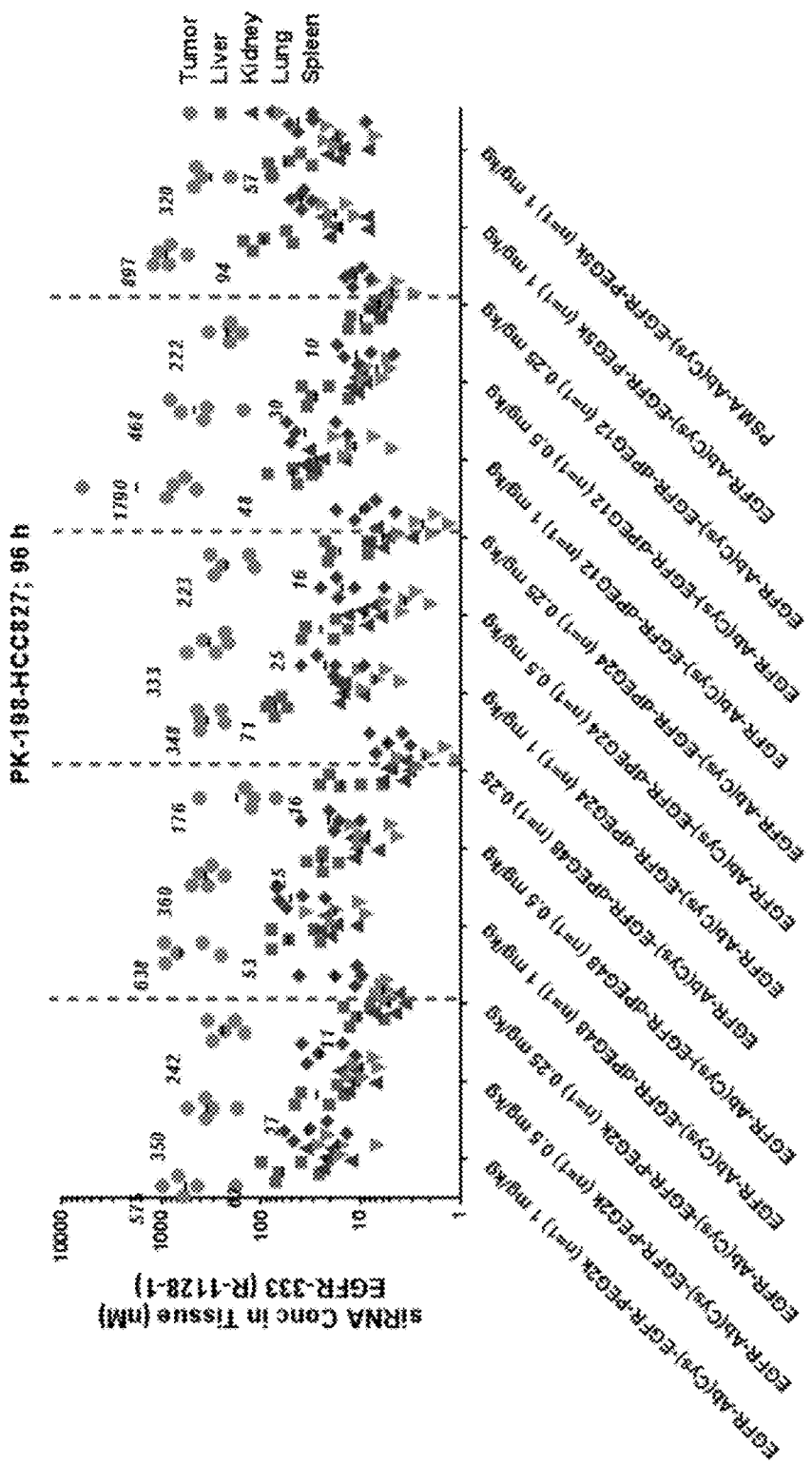
FIG. 81B illustrates siRNA concentrations of exemplary molecules encompassed by Formula (I) in tumor, liver, kidney, lung, and spleen tissue samples.
Figure 82:
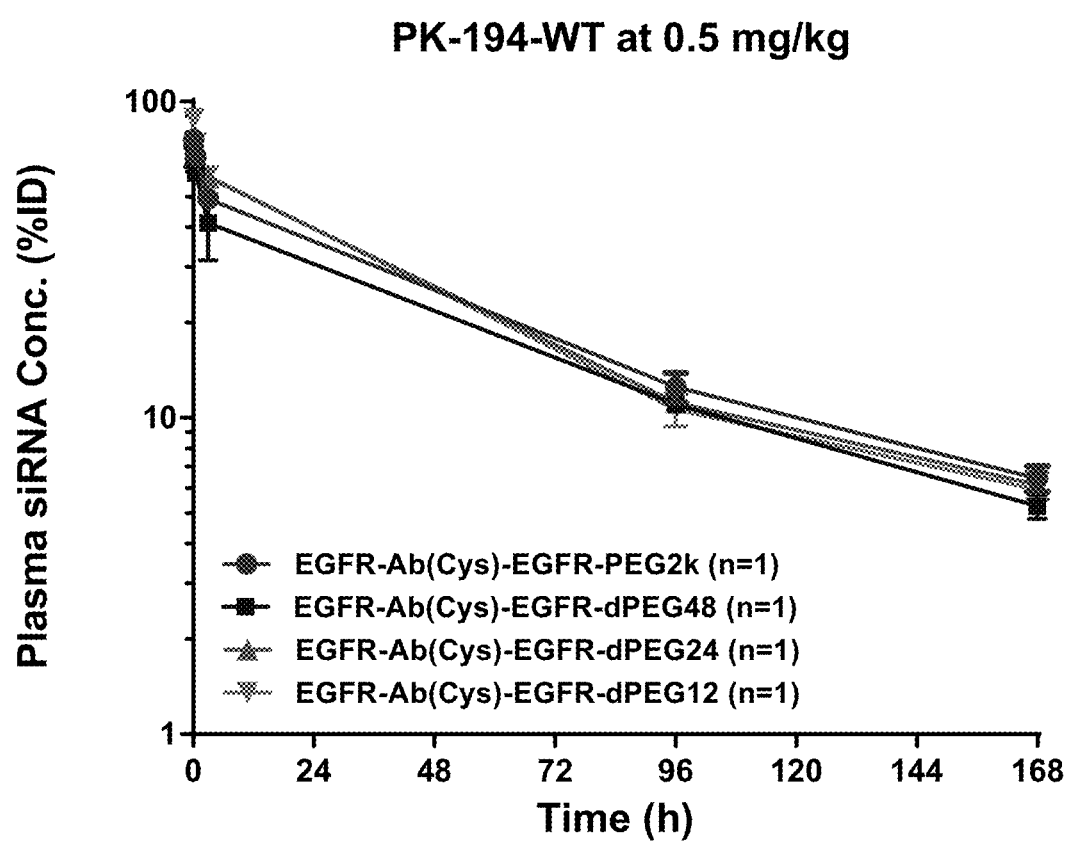
FIG. 82 illustrates plasma siRNA concentration of exemplary molecules encompassed by Formula (I).

As illustrated in FIG. 81A, all the ASC with the different configurations of linear PEG length achieved dose dependent EGFR mRNA knockdown in the HCC827 tumor cells, relative to the negative control siRNA sequence (scramble) and PBS controls. As illustrated in FIG. 81B, all the ASC with the different configurations in linear PEG length achieved equivalent dose dependent siRNA tumor tissue accumulation. In addition to low liver, lung, kidney and spleen accumulation relative to tumor.

In this example, it was demonstrated biological activity with a range of A-X—B—Y—C conjugates in which a variety of different PEG (component C) lengths were used.

Example 39: 2016-PK-194-WT siRNA Design and Synthesis

EFGR: A 21mer duplex with 19 bases of complementarity and 3' dinucleotide overhangs was designed against human EGFR. The sequence of the guide/antisense strand was complementary to the gene sequence starting a base position 333 for the human mRNA transcript for EGFR (ACUCGUGCCUUGGCAAACUUU; SEQ ID NO: 2082). Base, sugar and phosphate modifications were used to optimize the potency of the duplex and reduce immunogenicity. All siRNA single strands were fully assembled on solid phase using standard phosphoramidite chemistry and purified over HPLC. Purified single strands were duplexed to get the double stranded siRNA. The passenger strand contained two conjugation handles, a C6-NH2 at the 5' end and a C6-SH at the 3' end. Both conjugation handles were connected to siRNA passenger strand via phosphorothioate-inverted abasic-phosphorothioate linker, see Example 9 for the chemical structure.

ASC Synthesis and Characterization

All conjugates were made and purified as a DAR1 (n=1) using ASC architecture-4, as described in Example 9.

In Vivo Study Design

Groups (n=4) of wild-type female CD-1 mice were treated with one intravenous (i.v.) tail vein injections of siRNA conjugates. Treatment groups received 0.5 mg/kg (based on the weight of siRNA) and all groups were administered a dose volume of 5.0 mL/kg. Table 51 illustrates the study design in more detail. Non-terminal blood samples were collected at 5, 30, and 180 minutes post-dose via puncture of the retro-orbital plexus and centrifuged to generate plasma for PK analysis. Mice were sacrificed by $CO_2$ asphyxiation at 24, 96, or 168 h post-dose. Terminal blood samples were collected via cardiac puncture and processed to generate plasma for PK analysis. Quantitation of plasma siRNA concentrations were determined using a stem-loop qPCR assay as described in Example 2. The antisense strand of the siRNA was reverse transcribed using a TaqMan MicroRNA reverse transcription kit using a sequence-specific stem-loop RT primer. The cDNA from the RT step was then utilized for real-time PCR and Ct values were transformed into plasma or tissue concentrations using the linear equations derived from the standard curves.

TABLE 51

| Group | Test Article | N | siRNA Dose (mg/kg) | ROA | Dose Volume (mL/kg) | # of Doses | Survival Bleed (min) | Terminal Bleed (h) |
|---|---|---|---|---|---|---|---|---|
| 1 | EGFR-Ab(Cys)-EGFR-PEG2k | 4 | 0.5 | IV | 5.0 | 1 | 5 | 24 |
| 2 | (n = 1) | 4 | 0.5 | IV | 5.0 | 1 | 30 | 96 |
| 3 | | 4 | 0.5 | IV | 5.0 | 1 | 180 | 168 |
| 4 | EGFR-Ab(Cys)-EGFR-dPEG$_{48}$ | 4 | 0.5 | IV | 5.0 | 1 | 5 | 24 |
| 5 | (n = 1) | 4 | 0.5 | IV | 5.0 | 1 | 30 | 96 |
| 6 | | 4 | 0.5 | IV | 5.0 | 1 | 180 | 168 |
| 7 | EGFR-Ab(Cys)-EGFR-dPEG$_{24}$ | 4 | 0.5 | IV | 5.0 | 1 | 5 | 24 |
| 8 | (n = 1) | 4 | 0.5 | IV | 5.0 | 1 | 30 | 96 |
| 9 | | 4 | 0.5 | IV | 5.0 | 1 | 180 | 168 |
| 10 | EGFR-Ab(Cys)-EGFR-dPEG$_{12}$ | 4 | 0.5 | IV | 5.0 | 1 | 5 | 24 |
| 11 | (n = 1) | 4 | 0.5 | IV | 5.0 | 1 | 30 | 96 |
| 12 | | 4 | 0.5 | IV | 5.0 | 1 | 180 | 168 |
| | Total # of Animals: | 48 | | | WT mice CD-1 | | | |

As illustrated on slide 54, all the ASC with the different linear PEG lengths achieved equivalent plasma PK profiles, with approximately 10% of the siRNA remaining 168 hours after administration.

In this example, it was demonstrated equivalent plasma PK properties with a range of A-X—B—Y—C conjugates in which a variety of different PEG (component C) lengths were used.

Example 40: 2016-PK-195-WT siRNA Design and Synthesis

EFGR: A 21mer duplex with 19 bases of complementarity and 3' dinucleotide overhangs was designed against human EGFR. The sequence of the guide/antisense strand was complementary to the gene sequence starting a base position 333 for the human mRNA transcript for EGFR (ACUCGUGCCUUGGCAAACUUU; SEQ ID NO: 2082). Base, sugar and phosphate modifications were used to optimize the potency of the duplex and reduce immunogenicity. All siRNA single strands were fully assembled on solid phase using standard phospharamidite chemistry and purified over HPLC. Purified single strands were duplexed to get the double stranded siRNA. The passenger strand contained two conjugation handles, a C6-NH2 at the 5' end and a C6-SH at the 3' end. Both conjugation handles were connected to siRNA passenger strand via phosphorothioate-inverted abasic-phosphorothioate linker, see Example 9 for the chemical structure.

ASC Synthesis and Characterization

All conjugates were made and purified as a DAR1 (n=1) using ASC architecture-4, as described in Example 9.

In Vivo Study Design

Groups (n=4) of wild-type female CD-1 mice were treated with one intravenous (i.v.) tail vein injections of siRNA conjugates. Treatment groups received 0.5 mg/kg (based on the weight of siRNA) and all groups were administered a dose volume of 5.0 mL/kg. Table 52 illustrates the study design in more detail. Non-terminal blood samples were collected at 5, 30, and 180 minutes post-dose via puncture of the retro-orbital plexus and centrifuged to generate plasma for PK analysis. Mice were sacrificed by $CO_2$ asphyxiation at 24, 96, or 168 h post-dose. Terminal blood samples were collected via cardiac puncture and processed to generate plasma for PK analysis. Quantitation of plasma siRNA concentrations were determined using a stem-loop qPCR assay as described in Example 2. The antisense strand of the siRNA was reverse transcribed using a TaqMan MicroRNA reverse transcription kit using a sequence-specific stem-loop RT primer. The cDNA from the RT step was then utilized for real-time PCR and Ct values were transformed into plasma or tissue concentrations using the linear equations derived from the standard curves.

TABLE 52

| Group | Test Article | N | siRNA Dose (mg/kg) | ROA | Dose Volume (mL/kg) | # of Doses | Survival Bleed (min) | Terminal Bleed (h) |
|---|---|---|---|---|---|---|---|---|
| 1 | EGFR-Ab(Cys)-EGFR-PEG10k (n = 1) | 4 | 0.5 | IV | 5.0 | 1 | 5 | 24 |
| 2 | | 4 | 0.5 | IV | 5.0 | 1 | 30 | 96 |
| 3 | | 4 | 0.5 | IV | 5.0 | 1 | 180 | 168 |
| 4 | EGFR-Ab(Cys)-EGFR-(dPEG24)$_3$ (n = 1) | 4 | 0.5 | IV | 5.0 | 1 | 5 | 24 |
| 5 | | 4 | 0.5 | IV | 5.0 | 1 | 30 | 96 |
| 6 | | 4 | 0.5 | IV | 5.0 | 1 | 180 | 168 |
| 7 | EGFR-Ab(Cys)-EGFR-(dPEG12)$_3$ (n = 1) | 4 | 0.5 | IV | 5.0 | 1 | 5 | 24 |
| 8 | | 4 | 0.5 | IV | 5.0 | 1 | 30 | 96 |
| 9 | | 4 | 0.5 | IV | 5.0 | 1 | 180 | 168 |
| 10 | EGFR-Ab(Cys)-EGFR-(dPEG4)$_3$ (n = 1) | 4 | 0.5 | IV | 5.0 | 1 | 5 | 24 |
| 11 | | 4 | 0.5 | IV | 5.0 | 1 | 30 | 96 |
| 12 | | 4 | 0.5 | IV | 5.0 | 1 | 180 | 168 |
| | Total # of Animals: | 48 | | | WT mice CD-1 | | | |

Figure 83:
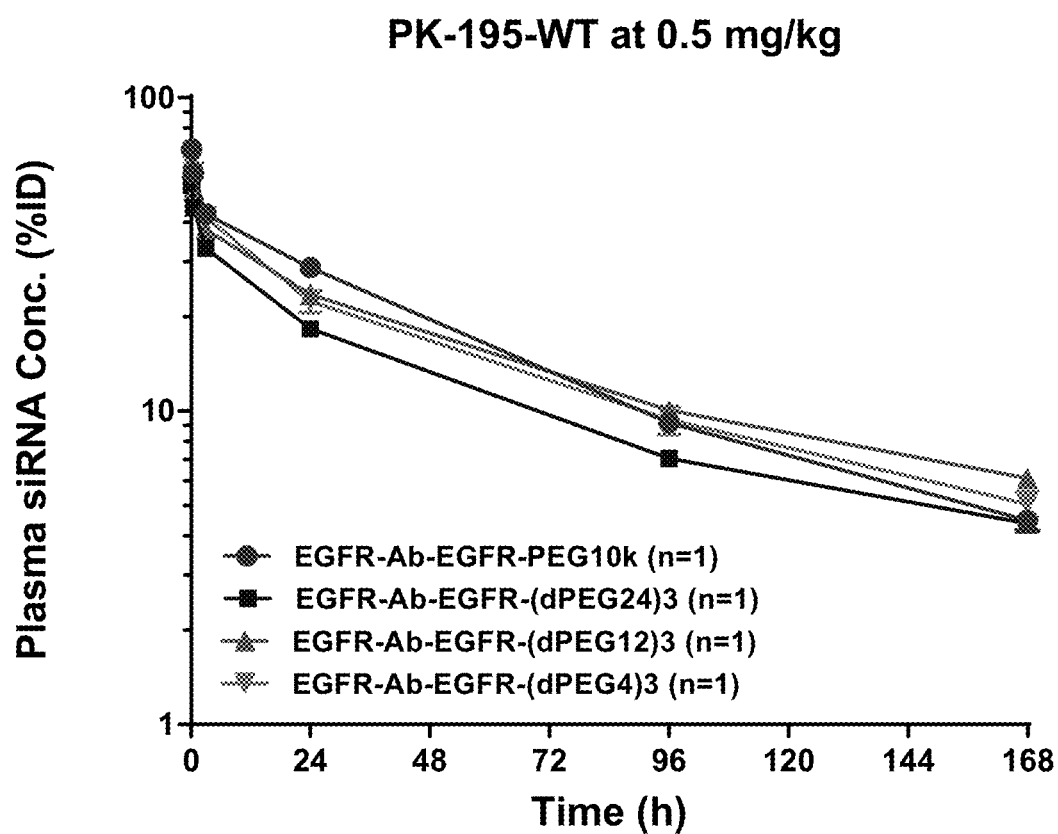
FIG. 83 illustrates plasma siRNA concentration of exemplary molecules encompassed by Formula (I).

As illustrated in FIG. 83, all the ASC with the different PEG configurations (length and branching) achieved equivalent plasma PK profiles, with approximately 10% of the siRNA remaining 168 hours after administration.

In this example, it was demonstrated equivalent plasma PK properties with a range of A-X—B—Y—C conjugates in which a variety of different PEG (component C) lengths and branching were used.

Example 41: 2016-PK-236-HCC827 siRNA Design and Synthesis

EFGR: A 21mer duplex with 19 bases of complementarity and 3' dinucleotide overhangs was designed against human EGFR. The sequence of the guide/antisense strand was complementary to the gene sequence starting a base position 333 for the human mRNA transcript for EGFR (ACUCGUGCCUUGGCAAACUUU; SEQ ID NO: 2082). Base, sugar and phosphate modifications were used to optimize the potency of the duplex and reduce immunogenicity. All siRNA single strands were fully assembled on solid phase using standard phospharamidite chemistry and purified over HPLC. Purified single strands were duplexed to get the double stranded siRNA. The passenger strand contained two conjugation handles, a C6-NH2 at the 5' end and a C6-SH at the 3' end. Both conjugation handles were connected to siRNA passenger strand via phosphorothioate-inverted abasic-phosphorothioate linker, see Example 9 for the chemical structure.

Negative control siRNA sequence (scramble): A published (Burke et al. (2014) Pharm. Res., 31(12):3445-60) 21mer duplex with 19 bases of complementarity and 3' dinucleotide overhangs was used. The sequence (5' to 3') of the guide/antisense strand was UAUCGACGUGUCCAGC-UAGUU (SEQ ID NO: 2116). Base, sugar and phosphate modifications were used to reduce immunogenicity and were comparable to those used in the active siRNA. All siRNA single strands were fully assembled on solid phase using standard phospharamidite chemistry and purified over HPLC. Purified single strands were duplexed to get the double stranded siRNA. The passenger strand contained two conjugation handles, a C6-NH2 at the 5' end and a C6-SH at the 3' end. Both conjugation handles were connected to siRNA passenger strand via a phosphodiester-inverted abasic-phosphodiester linker, see Example 9 for the chemical structure.

ASC Synthesis and Characterization

All conjugates were made and purified as a DAR1 (n=1) using ASC architecture-4, as described in Example 9.

In Vivo Study Design

Figure 85:
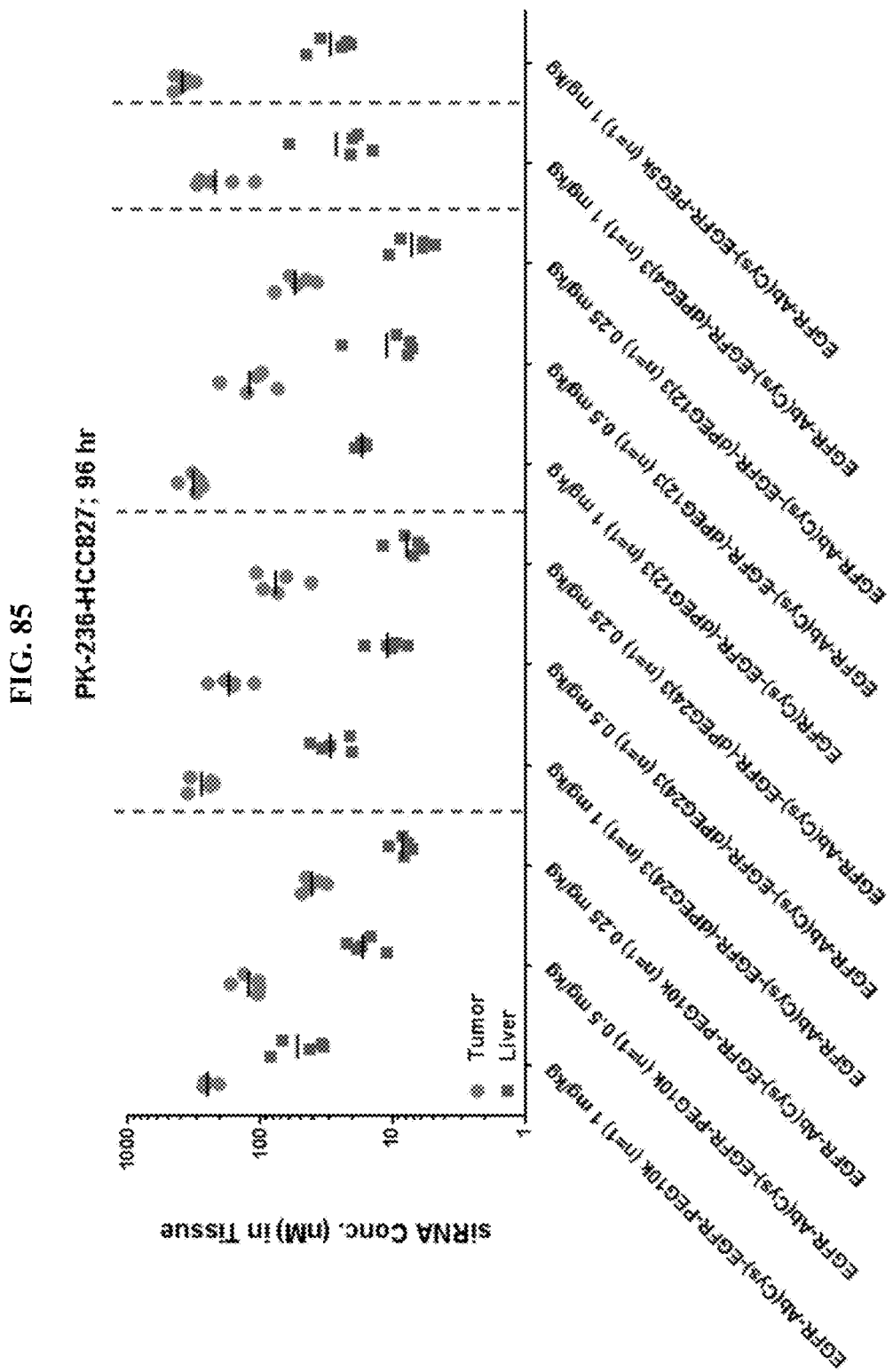
FIG. 85 illustrates siRNA concentration in HCC827 tumor or liver tissues at 96 hour post-dose.

Groups 1-12 (n=5) of female NCr nu/nu mice bearing subcutaneously (SC) flank HCC827 tumors 100-300 mm$^3$ in volume were treated with one intravenous (i.v.) tail vein injection of siRNA conjugate, while control group 13 (n=5) of the same mice received one i.v. injection of PBS as a vehicle control. Table 53 describes the study design. Mice were sacrificed by $CO_2$ asphyxiation at 96 hours post-dose. 50 mg pieces of tumor and liver, were collected and snap-frozen in liquid nitrogen. mRNA knockdown in target tissue was determined using a comparative qPCR assay as described in Example 2. Total RNA was extracted from the tissue, reverse transcribed and mRNA levels were quantified using TaqMan qPCR, using the appropriately designed primers and probes. PPIB (housekeeping gene) was used as an internal RNA loading control, results were calculated by the comparative Ct method, where the difference between the target gene Ct value and the PPIB Ct value ($\Delta$Ct) is calculated and then further normalized relative to the PBS control group by taking a second difference ($\Delta\Delta$Ct). Quantitation of tissue siRNA concentrations were determined using a stem-loop qPCR assay as described in Example 2. The antisense strand of the siRNA was reverse transcribed using a TaqMan MicroRNA reverse transcription kit using a sequence-specific stem-loop RT primer. The cDNA from the RT step was then utilized for real-time PCR and Ct values were transformed into plasma or tissue concentrations using the linear equations derived from the standard curves.

showed dose dependent knockdown of EGFR mRNA. As illustrated in FIG. 85, all the ASC with the different variations in linear PEG length and PEG branching achieved equivalent siRNA tumor tissue accumulation to the construct with the linear PEG5K at the 1 mg/kg dose. In addition to low liver accumulation relative to tumor, those constructs tested in a dose response format, showed dose dependent tumor tissue accumulation of siRNA.

In this example, it was demonstrated biological activity with a range of A-X—B—Y—C conjugates in which a variety of different PEG (component C) lengths and branching were used.

Example 42: In Vitro Knockdown with ASCs with PEG Polymers siRNA Design and Synthesis HPRT: A 21mer duplex with 19 bases of complementarity and 3' dinucleotide overhangs was designed against human HPRT. The sequence of the guide/antisense strand was AUAAAAUCUACAGUCAUAGUU (SEQ ID NO: 2082) and design to be complementary to the gene sequence starting a base position 425 for the human mRNA transcript for HPRT. Base, sugar and phosphate modifications were used to optimize the potency of the duplex and reduce immunogenicity. All siRNA single strands were fully assembled on solid phase using standard phospharamidite chemistry and purified over HPLC. Purified single strands were duplexed to get the double stranded siRNA. The passenger strand contained two conjugation handles, a $C6-NH_2$ at the 5' end and a C6-SH at the 3' end. Both conjugation handles were connected to siRNA passenger strand via phosphodiester-inverted abasic-phosphorothioate linker. The C6-NH2 and C6-SH were connected through the phosphodiester, see Example 9 for the chemical structure.

Negative control siRNA sequence (scramble): A published (Burke et al. (2014) Pharm. Res., 31(12):3445-60) 21mer duplex with 19 bases of complementarity and 3' dinucleotide overhangs was used. The sequence (5' to 3') of the guide/antisense strand was UAUCGACGUGUCCAGC-UAGUU (SEQ ID NO: 2116). The same base, sugar and phosphate modifications that were used for the active EGFR

TABLE 53

| Group | Test Article | N | siRNA Dose (mg/kg) | ROA | Dose Volume (mL/kg) | # of Doses | Harvest Time (h) |
|---|---|---|---|---|---|---|---|
| 1 | EGFR-Ab(Cys)-EGFR-PEG10k (n = 1) | 5 | 1 | IV | 5.0 | 1 | 96 |
| 2 | EGFR-Ab(Cys)-EGFR-PEG10k (n = 1) | 5 | 0.5 | IV | 5.0 | 1 | 96 |
| 3 | EGFR-Ab(Cys)-EGFR-PEG10k (n = 1) | 5 | 0.25 | IV | 5.0 | 1 | 96 |
| 4 | EGFR-Ab(Cys)-EGFR-(dPEG24)3 (n = 1) | 5 | 1 | IV | 5.0 | 1 | 96 |
| 5 | EGFR-Ab(Cys)-EGFR-(dPEG24)3 (n = 1) | 5 | 0.5 | IV | 5.0 | 1 | 96 |
| 6 | EGFR-Ab(Cys)-EGFR-(dPEG24)3 (n = 1) | 5 | 0.25 | IV | 5.0 | 1 | 96 |
| 7 | EGFR-Ab(Cys)-EGFR-(dPEG12)3 (n = 1) | 5 | 1 | IV | 5.0 | 1 | 96 |
| 8 | EGFR-Ab(Cys)-EGFR-(dPEG12)3 (n = 1) | 5 | 0.5 | IV | 5.0 | 1 | 96 |
| 9 | EGFR-Ab(Cys)-EGFR-(dPEG12)3 (n = 1) | 5 | 0.25 | IV | 5.0 | 1 | 96 |
| 10 | EGFR-Ab(Cys)-EGFR-(dPEG4)3 (n = 1) | 5 | 1 | IV | 5.0 | 1 | 96 |
| 11 | EGFR-Ab(Cys)-EGFR-PEG5k (n = 1) | 5 | 1 | IV | 5.0 | 1 | 96 |
| 12 | EGFR-Ab(Cys)-scramble-PEG5k (n = 1) | 5 | 1 | IV | 5.0 | 1 | 96 |
| 13 | PBS Control | 5 | — | IV | 5.0 | 1 | 96 |
| | Total # of Animals: | 65 | nu/nu mice with HCC827 tumors | | | | |

Figure 84:
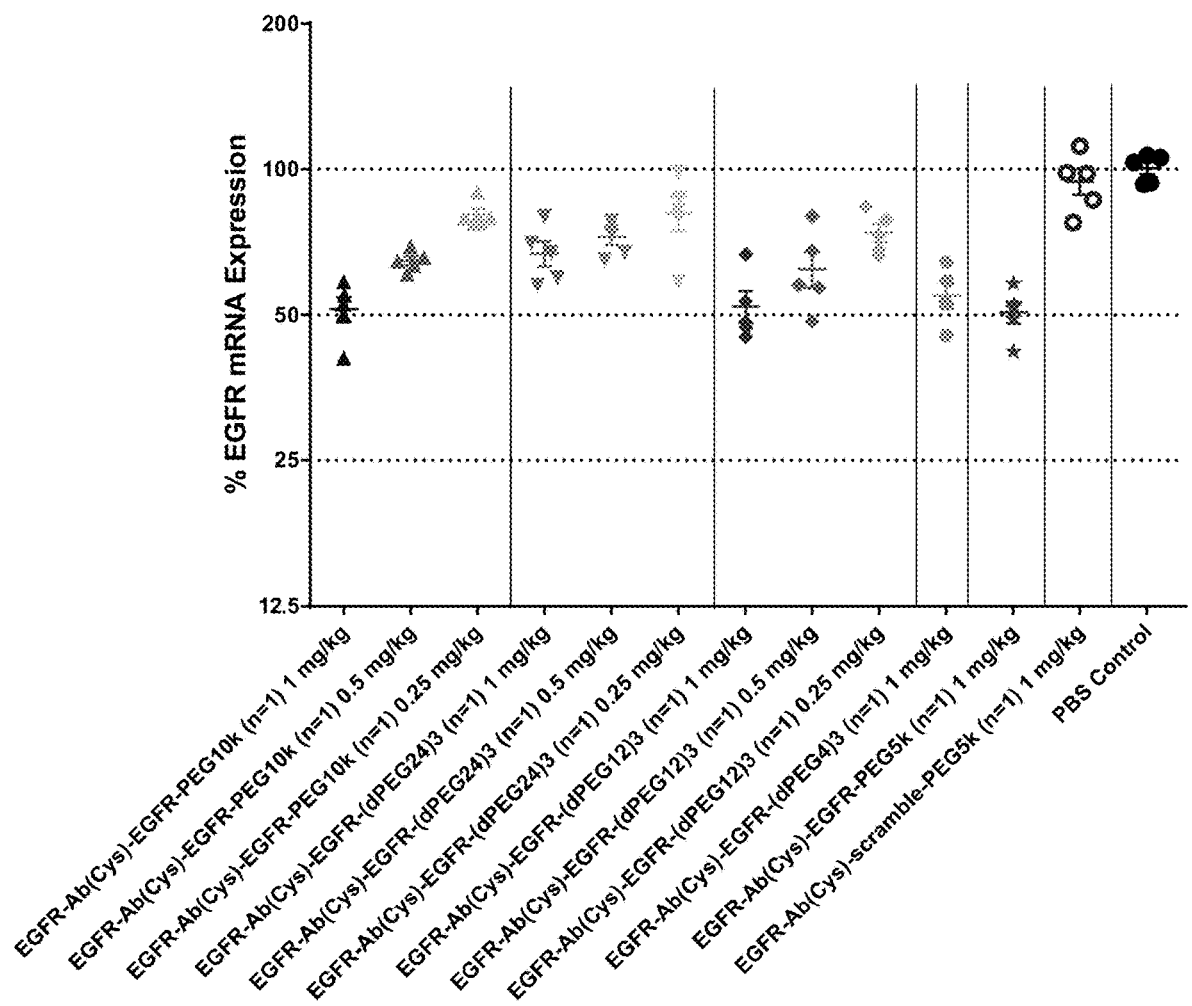
FIG. 84 illustrates mRNA expression levels of exemplary molecules encompassed by Formula (I) in HCC827 tumor at 96 h post treatment.

As illustrated in FIG. 84, all the ASC with the different configurations of PEG (length and branching) achieved equivalent EGFR mRNA knockdown in the HCC827 tumor cells to the construct with the linear PEG5K at the 1 mg/kg dose. Those constructs tested in a dose response format, siRNA duplex were used in the negative control siRNA. All siRNA single strands were fully assembled on solid phase using standard phospharamidite chemistry and purified over HPLC. Purified single strands were duplexed to get the double stranded siRNA. The passenger strand contained two conjugation handles, a C6-NH2 at the 5' end and a C6-SH at the 3' end. Both conjugation handles were connected to siRNA passenger strand via a phosphodiester-inverted abasic-phosphodiester linker, see Example 9 for the chemical structure.

ASC Synthesis and Characterization

Conjugates in groups 1-3 made and purified as a DAR1 (n=1) using ASC architecture-1, as described in Example 9. Conjugates in groups 4-6 were made and purified as a DAR1 (n=1) using ASC architecture-4, as described in Example 9.

In Vitro Study Design

Mouse spleens were harvested and kept in PBS with 100 u/ml penicillin and streptomycin on ice. Spleens were smashed with clean glass slides, cut into small pieces, homogenized with 18G needles, and filtered (70 urn nylon membrane). Dead cells were removed with the dead cell removal kit from Milteny biotec (Catalog#130-090101) according to manufacturer instruction. To isolate mouse B cells, B cell isolation kit Milteny biotec (Catalog#130-090-862) was used following manufacturer instruction. Briefly, live spleen cells were resuspended with 200 µl of MACS buffer per mouse spleen. Non-B cells were depleted with biotin-conjugated monoclonal antibodies against CD43 (Ly48), CD4, and Ter-119, coupled with anti-biotin magnetic microbeads. From one mouse spleen, 30 million live B cells can be obtained. To activate isolated mouse B cells ($2\times10^6$/ml in 10% FBS RPMI-1640 with 100 u/ml penicillin and streptomycin), a cocktail of 10 µg/ml LPS, 5 µg/ml anti-IgM, 1 µg/ml anti-CD40, 0.05 µg/ml IL-4, and 0.5 µg/ml INFγ was added. After four hours of activation, ASCs (1 pM to 10 nM) were added to $10^6$ cells per well in 24 (0.5 ml media) or 12 (1 ml media) well plates. After 48 hours of ASC treatments, cells were harvested and isolated RNAs were analyzed for mRNA knockdown. See Table 54 for the study design.

TABLE 54

| Group | Test Article |
|---|---|
| 1 | Anti-B cell Ab(Lys)-S3'-HPRT-5'N-pOEGMA8K |
| 2 | Anti-B cell Ab(Lys)-S3'-HPRT-5'N-pHPMA5K |
| 3 | Anti-B cell Ab(Lys)-S3'-HPRT-5'N-pHPMA10K |
| 4 | Anti-B cell Ab(Cys)-N5'-HPRT-3'S-pMAA10K |
| 5 | Anti-B cell Ab(Cys)-N5'-HPRT-3'S-PEG5K |
| 6 | Anti-B cell Ab(Cys)-N5'-scramble-3'S-PEG5K |

Figure 86:
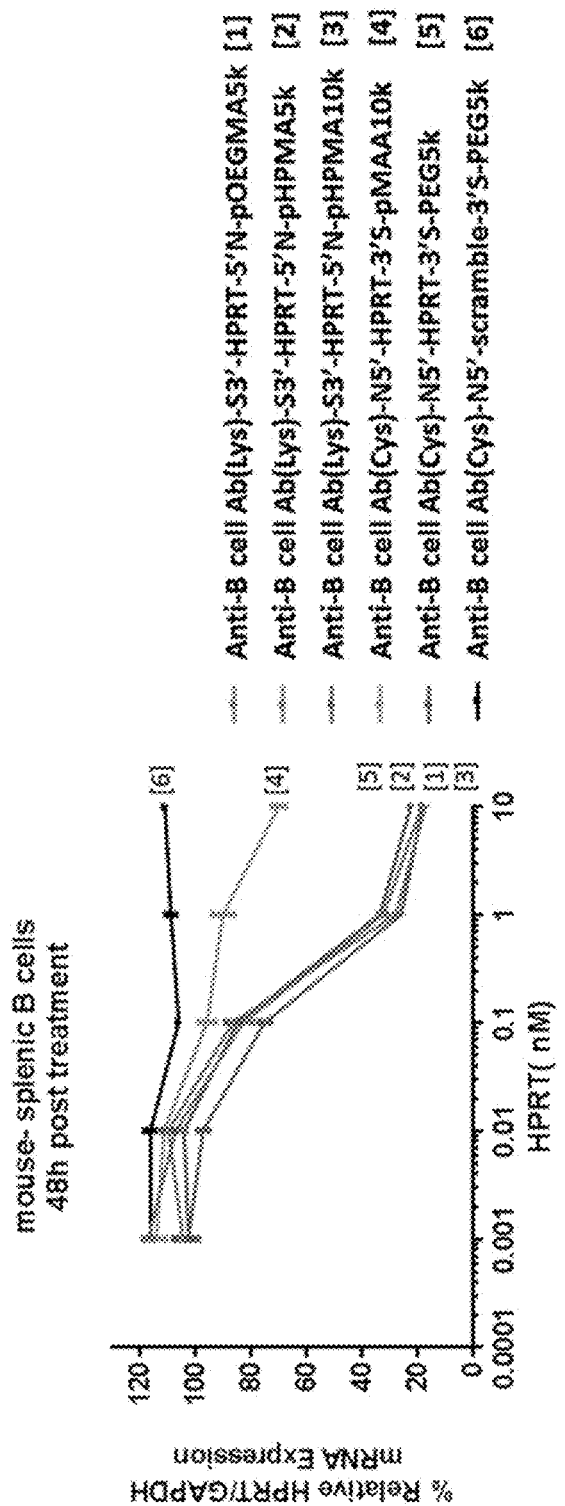
FIG. 86 illustrates the relative mRNA expression levels of exemplary molecules encompassed by Formula (I) in mouse splenic B cells 48 h post treatment. Each exemplary molecule is further denoted with a number.

In this in vitro experiment in activated primary mouse B cells, the ability of an anti-B cell antibody ASCs to deliver an siRNA design to downregulate Hypoxanthine-guanine phosphoribosyltransferase (HPRT) with a range of alternative PEG polymers were measured. As illustrated in FIG. 86, the range of ASC with alternative PEGs were able to downregulate HPRT relative to the scramble control.

In this example, the biological activity was demonstrated with a range of A-X—B—Y—C conjugates in which a variety of polymer alternatives to PEG (component C) were used.

Example 43: PK-236-WT siRNA Design and Synthesis

KRAS: A 21mer duplex with 19 bases of complementarity and 3' dinucleotide overhangs was designed against human KRAS. The sequence of the guide/antisense strand was complementary to the gene sequence starting a base position 237 for the human mRNA transcript for KRAS (Guide strand sequence: UGAAUUAGCUGUAUCGUCAUU; SEQ ID NO: 2088). Base, sugar and phosphate modifications that are well described in the field of RNAi were used to optimize the potency of the duplex and reduce immunogenicity. All siRNA single strands were fully assembled on solid phase using standard phospharamidite chemistry and purified over HPLC. The base at position 11 on the passenger strand had a Cy5 fluorescent label attached, as described in Example 9. Purified single strands were duplexed to get the double stranded siRNA. The passenger strand contained two conjugation handles, a C6-NH2 at the 5' end and a C6-SH at the 3' end. Both conjugation handles were connected to siRNA passenger strand via a phosphodiester-inverted abasic-phosphodiester linker, see Example 9 for the chemical structure.

ASC Synthesis and Characterization

Conjugates in groups 1-3 were made and purified as a DAR1 (n=1) using ASC architecture-4, as described in Example 9. Conjugates in groups 4-6 were made and purified as a DAR1 (n=1) using ASC architecture-4, but there was no PEG on the 3' end of the passenger strand. Prior to conjugation, the 3'thiol was end-capped using N-ethylmaleimide. Conjugates in groups 7-9 were made and purified as a DAR1 (n=1) using ASC architecture-1, as described in Example 9. Conjugates in groups 10-12 made and purified as a DAR1 (n=1) using ASC architecture-1, but there was no PEG on the 5' end of the passenger strand.

In Vivo Study Design

Groups (n=4) of wild-type female CD-1 mice were treated with one intravenous (i.v.) tail vein injections of siRNA conjugates. Treatment groups received 0.5 mg/kg (based on the weight of siRNA) and all groups were administered a dose volume of 5.0 mL/kg. Table 55 illustrates the study design in more detail. Non-terminal blood samples were collected at 0.25, 1, and 4 hours post-dose via puncture of the retro-orbital plexus and centrifuged to generate plasma for PK analysis. Mice were sacrificed by $CO_2$ asphyxiation at 24, 48, or 72 h post-dose. Terminal blood samples were collected via cardiac puncture and processed to generate plasma for PK analysis.

Plasma samples (K2 EDTA) were processed within 4 hours after harvesting. Plasma samples were diluted with matching mouse plasma (Bioreclamation) (2-400 fold) and the concentration of CY5-siRNA in these plasma samples quantified spectroscopically using a TECAN Infinite M200 Pro (Excitation 635 nm; Emission 675 nm). To release macromolecular interactions that might quench the CY5 fluorescence, all samples were diluted 2-fold into water containing 0.01% Tween 20 and 100 ug/ml heparin prior to quantification. To determine the amount of intact ASCs in these plasma samples, plasma samples were diluted with mouse plasma to 2-50 nM CY5-siRNA and incubated with Protein G Dynabeads (Thermofisher) loaded with 150 nM of a purified EGFR-Fc protein (Sino Biological). These binding reactions were incubated at RT for 1 hour. Beads were washed twice with PBS containing 0.01% Tween 20 and 0.05% BSA before ASCs bound to EGFR were eluted by incubation in 0.1 M citric acid (pH 2.7). The amount of CY5-siRNA contained in the input, unbound fraction, washes and bead eluate was quantified by fluorescence as stated above.

TABLE 55

| Group | Test Article | N | siRNA Dose (mg/kg) | ROA | Dose Volume (mL/kg) | # of Doses | Survival Bleed (min) | Terminal Bleed (h) |
|---|---|---|---|---|---|---|---|---|
| 1 | EGFR-Ab(Cys)-N5'-Cy5.KRAS-3'S-PEG5k (n = 1) | 4 | 0.5 | IV | 5.0 | 1 | 0.25 | 24 |
| 2 | EGFR-Ab(Cys)-N5'-Cy5.KRAS-3'S-PEG5k (n = 1) | 4 | 0.5 | IV | 5.0 | 1 | 1 | 48 |
| 3 | EGFR-Ab(Cys)-N5'-Cy5.KRAS-3'S-PEG5k (n = 1) | 4 | 0.5 | IV | 5.0 | 1 | 4 | 72 |
| 4 | EGFR-Ab(Cys)-N5'-Cy5.KRAS-3'S--NEM (n = 1) | 4 | 0.5 | IV | 5.0 | 1 | 0.25 | 24 |
| 5 | EGFR-Ab(Cys)-N5'-Cy5.KRAS-3'S--NEM (n = 1) | 4 | 0.5 | IV | 5.0 | 1 | 1 | 48 |
| 6 | EGFR-Ab(Cys)-N5'-Cy5.KRAS-3'S--NEM (n = 1) | 4 | 0.5 | IV | 5.0 | 1 | 4 | 72 |
| 7 | EGFR-Ab(Lys)-S3'-Cy5.KRAS-5'N-PEG5k (n = 1) | 4 | 0.5 | IV | 5.0 | 1 | 0.25 | 24 |
| 8 | EGFR-Ab(Lys)-S3'-Cy5.KRAS-5'N-PEG5k (n = 1) | 4 | 0.5 | IV | 5.0 | 1 | 1 | 48 |
| 9 | EGFR-Ab(Lys)-S3'-Cy5.KRAS-5'N-PEG5k (n = 1) | 4 | 0.5 | IV | 5.0 | 1 | 4 | 72 |
| 10 | EGFR-Ab(Lys)-S3'-Cy5.KRAS-5'NH$_2$ (n = 1) | 4 | 0.5 | IV | 5.0 | 1 | 0.25 | 24 |
| 11 | EGFR-Ab(Lys)-S3'-Cy5.KRAS-5'NH$_2$ (n = 1) | 4 | 0.5 | IV | 5.0 | 1 | 1 | 48 |
| 12 | EGFR-Ab(Lys)-S3'-Cy5.KRAS-5'NH$_2$ (n = 1) | 4 | 0.5 | IV | 5.0 | 1 | 4 | 72 |
| | Total # of Animals: | 96 | | | WT mice CD-1 | | | |

Figure 87:
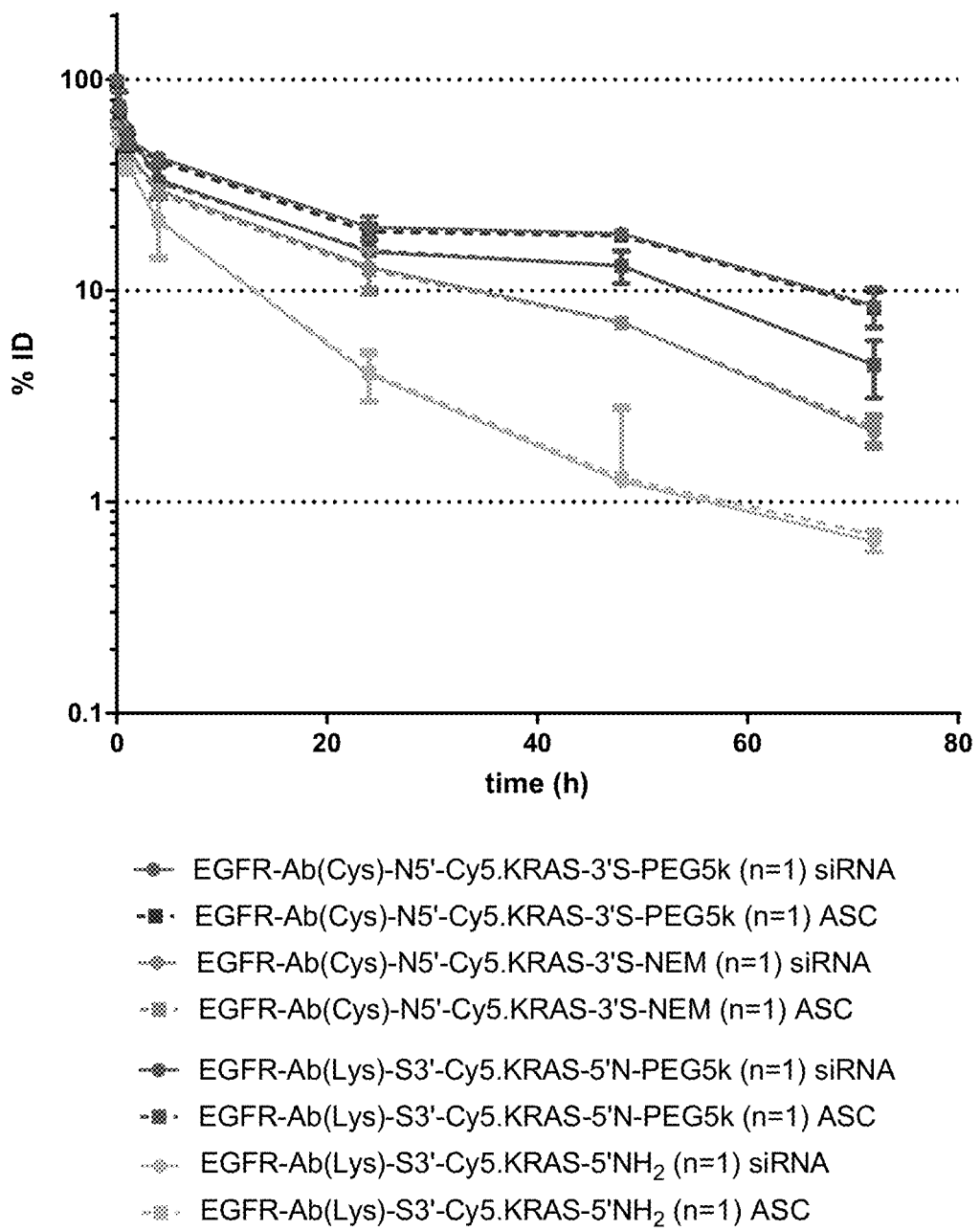
FIG. 87 illustrates stability of exemplary molecules encompassed by Formula (I) (or ASCs) in mouse plasma.

In this in vivo PK study, the in vivo plasma stability of two AXBYC conjugates (cysteine and lysine conjugation to the EGFR-Ab) relative to two AXB conjugates were compared. As illustrated in FIG. 87, the concentration of the siRNA was determined using two methods. The fluorescence of the plasma was measured directly and the siRNA concentration determined using a standard curve. Or a magnetic bead decorated with EGFR was used to bind the antibody conjugates and then the fluorescence of the sample was measured and the siRNA concentration determined using a standard curve. All data were plotted as a percentage of the injected dose. In both examples of the AXBYC conjugates (cysteine and lysine conjugation to the EGFR-Ab) improved plasma PK were observed relative to the corresponding AXB conjugate.

In this example, in vivo plasma PK for the Cys and Lys AXBYC conjugates compared to the matching control AXB conjugates was demonstrate.

Example 44: In Vivo Pharmacodynamics Study of a Cholesterol-KRAS Conjugate (PD-058)

Groups (n=5) of female NCr nu/nu mice bearing intrahepatic Hep 3B tumors one week after inoculation were treated with three intravenous (i.v.) tail vein injections (separated by 48 h) of cholesterol-siRNA conjugate, while control groups (n=5) of the same mice received three i.v. injections of PBS as a vehicle control on the same dosing schedule. Treatment groups that received chol-KRAS were dosed at 10, 4, or 2 mg/kg. All groups (treatments and controls) were administered a dose volume of 6.25 mL/kg. Table 56 describes the study design in more detail and gives a cross-reference to the conjugate synthesis and characterization. Mice were sacrificed by CO$_2$ asphyxiation at 72 h post-final dose. 50 mg pieces of tumor-bearing liver were collected and snap-frozen in liquid nitrogen. mRNA knockdown analysis and siRNA quantitation were performed as described in Examples 2-7.

TABLE 56

Study design for a Cholesterol-KRAS Conjugate (PD-058) with a cross-reference to the synthesis and characterization of the conjugates tested.

| Group | Test Article | N | siRNA Dose (mg/kg) | ROA | # of Doses | Cross-reference for synthesis and characterization |
|---|---|---|---|---|---|---|
| 1 | Chol-KRAS | 5 | 10 | iv | 3 | General experimental (Example 2) |
| 2 | Chol-KRAS | 5 | 4 | iv | 3 | General experimental (Example 2) |
| 3 | Chol-KRAS | 5 | 2 | iv | 3 | General experimental (Example 2) |
| 4 | Vehicle (PBS) | 5 | | iv | 3 | |

Figure 35:
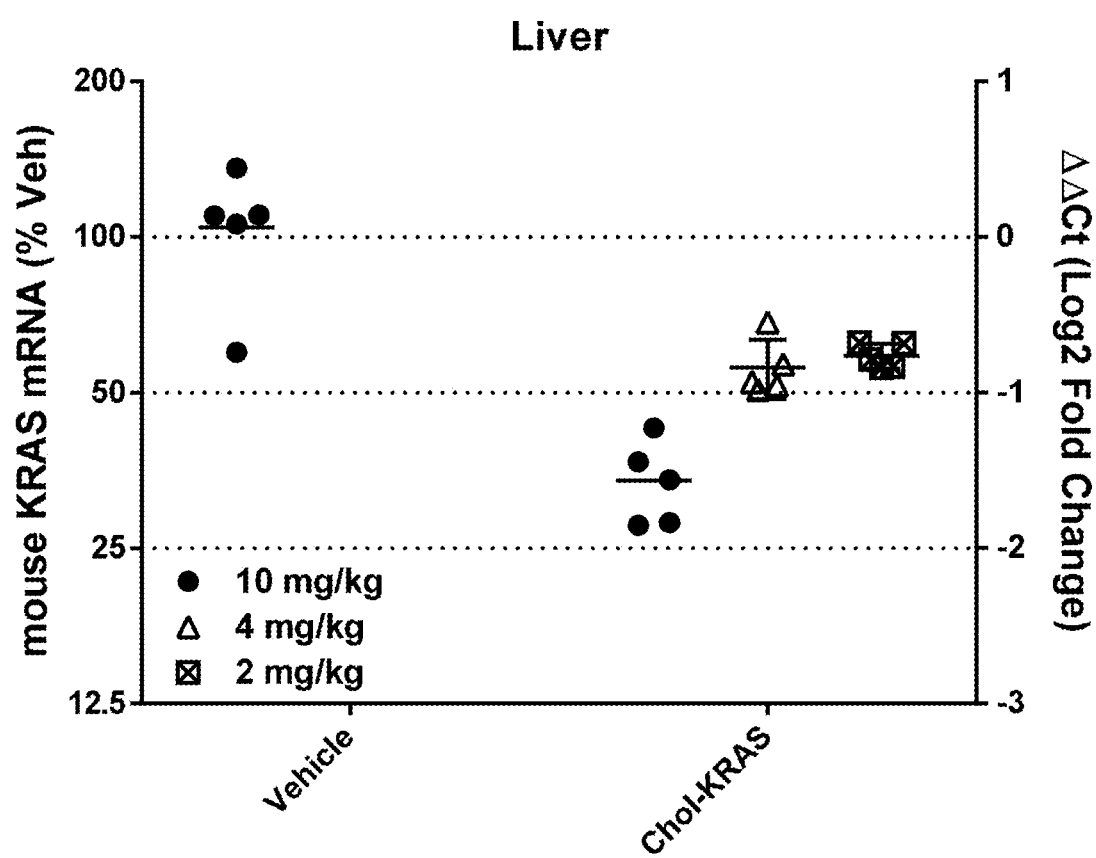
FIG. 35 shows siRNA-mediated mRNA knockdown of mouse KRAS in mouse liver.

The chol-KRAS conjugate was assessed for mRNA knockdown in a 3-dose study with a dose response. As illustrated in FIG. 35, within the mouse liver tissue there was a clear dose-response for mouse KRAS mRNA knockdown. The lowest dose of 2 mg/kg resulted in 45% knockdown of mouse KRAS, while the highest dose of 10 mg/kg resulted in 65% knockdown of mouse KRAS in this 3-dose format. However, there were not enough human tumor cells in the mouse liver at the time of harvest to detect a signal from human KRAS (potentially due to model development issues, it appeared that not enough human cells were inoculated to produce fast-growing tumors). As such, it was not possible to measure the knockdown in tumor.

Example 45: In Vivo Pharmacokinetics Study of a Cholesterol-siRNA Conjugate (PK-063)

Groups (n=3) of wild-type female CD-1 mice were treated with either one or two intravenous (i.v.) tail vein injections of chol-siRNA conjugate. Treatment groups received chol-KRAS at 10 mg/kg (based on the weight of siRNA) and the 2-dose groups received the second dose 48 h after the first dose. All groups were administered a dose volume of 6.25 mL/kg. Table 57 illustrates the study design in more detail and gives a cross-reference to the conjugate synthesis and characterization. Non-terminal blood samples were collected at 2, 15, 60 or 120 minutes post-final dose via puncture of the retro-orbital plexus and centrifuged to generate plasma for PK analysis. Mice were sacrificed by CO$_2$ asphyxiation at 4, 24, 96, or 144 h post-final dose. Terminal blood samples were collected via cardiac puncture and processed to generate plasma for PK analysis. 50 mg pieces of tumor, liver, kidney, and lung were collected and snap-frozen in liquid nitrogen. mRNA knockdown analysis and siRNA quantitation were performed as described in Examples 2-7.

TABLE 57

Study design for a Cholesterol-siRNA Conjugate
(PK-063) with a cross-reference to the synthesis
and characterization of the conjugates tested.

| Group | Test Article | N | siRNA Dose (mg/kg) | ROA | # of Doses | Survival Bleed (min) | Terminal Bleed (h) | Harvest Time (h) | Cross-reference to synthesis and characterization |
|---|---|---|---|---|---|---|---|---|---|
| 1 | Chol- | 3 | 10 | IV | 1 | 2 | 4 | 4 | General |
| 2 | KRAS | 3 | 10 | IV | 1 | 15 | 24 | 24 | experimental |
| 3 |  | 3 | 10 | IV | 1 | 60 | 96 | 96 | (Example 2) |
| 4 |  | 3 | 10 | IV | 1 | 120 | 144 | 144 |  |
| 5 | Chol- | 3 | 10 | IV | 2 | 2 | 4 | 4 | General |
| 6 | KRAS | 3 | 10 | IV | 2 | 15 | 24 | 24 | experimental |
| 7 |  | 3 | 10 | IV | 2 | 60 | 96 | 96 | (Example 2) |
| 8 |  | 3 | 10 | IV | 2 | 120 | 144 | 144 |  |

Figure 36:
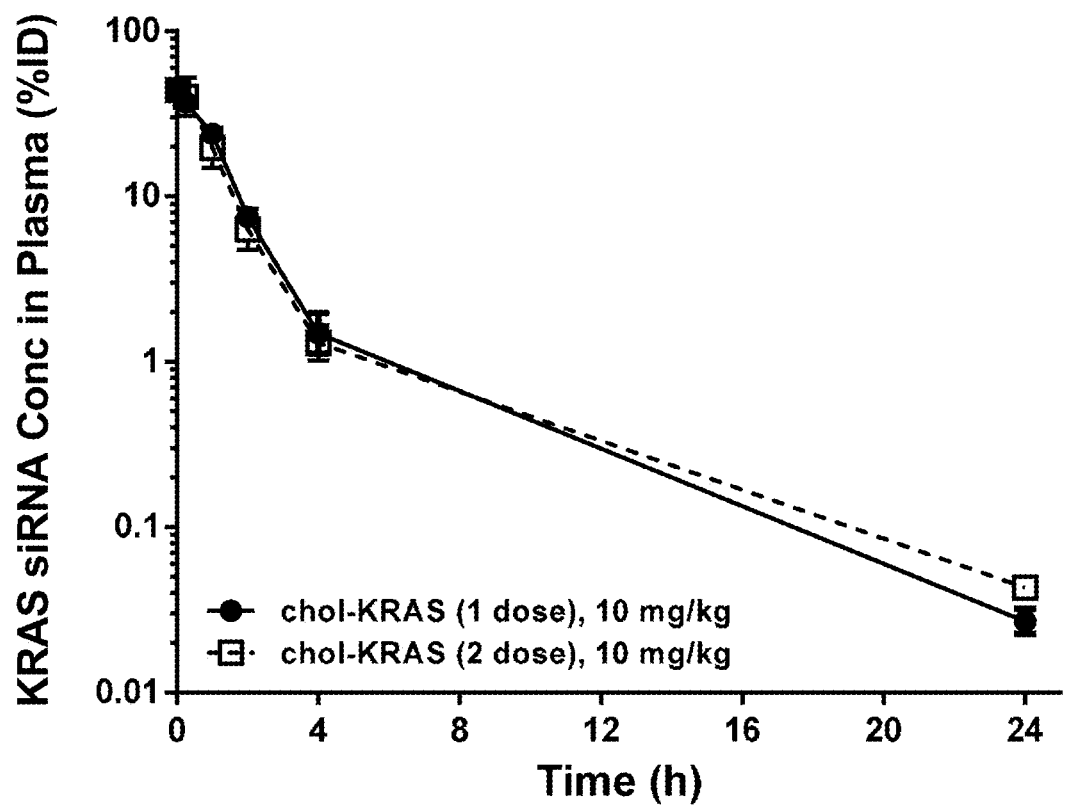
FIG. 36 illustrates plasma concentration-time profiles out to 96 h post-dose with the siRNA concentration expressed as a percent of injected dose (% ID).
Figure 37:
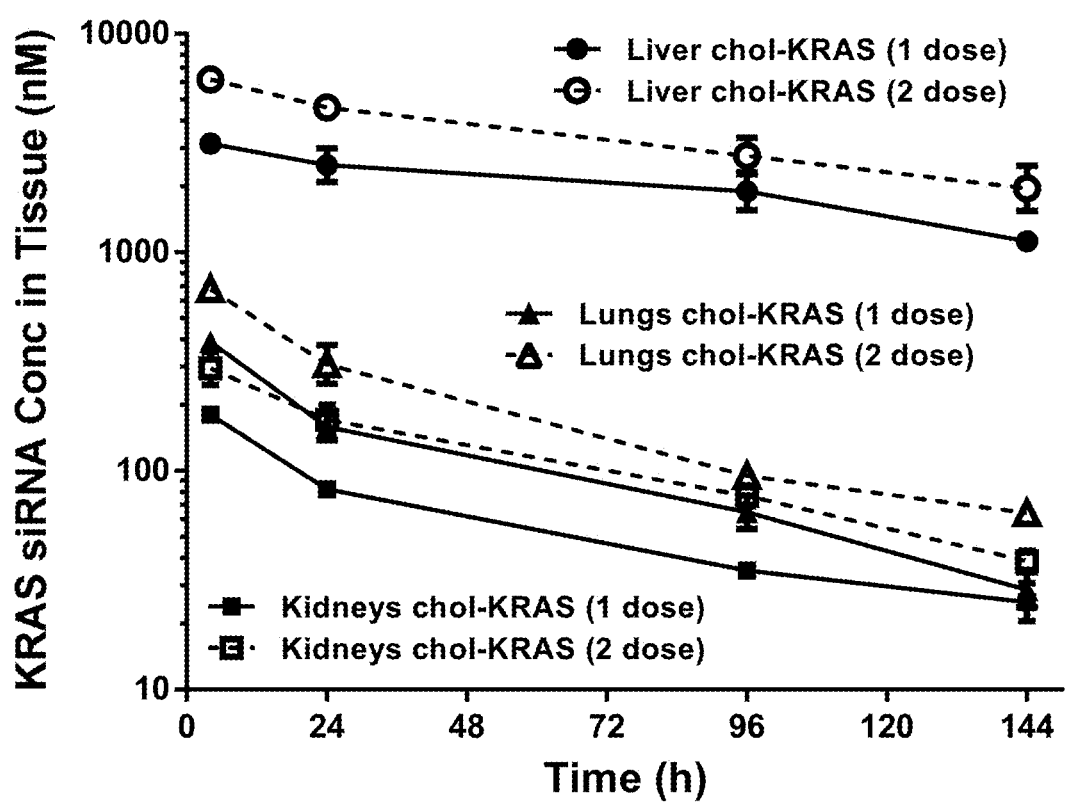
FIG. 37 illustrates tissue concentration-time profiles out to 144 h post-dose measured in liver, kidneys, and lungs of wild-type CD-1 mice.

The pharmacokinetic behavior of chol-siRNA was assessed in a single-dose format compared to a 2-dose format. As illustrated from FIG. 36, the plasma PK profiles for the first dose and a second dose following 48 h later are nearly identical. The mechanism for clearance from plasma has not saturated from the first dose and the second dose behaves similarly. The tissue PK for 3 major tissues (the liver, kidneys, and lungs) was similarly assessed. As illustrated from FIG. 37, chol-KRAS was delivered to liver in the highest concentrations, with kidneys and lungs having approximately 10-fold lower siRNA concentrations compared to liver. For all three tissues, the siRNA concentrations following the second doses were higher than the siRNA concentrations following the first dose, demonstrating that there is accumulation of siRNA in tissues when doses of chol-siRNA are spaced by 48 h.

In Vivo Study a Cholesterol-siRNA Conjugate (PK-067).

Groups (n=3) of female NCr nu/nu mice bearing subcutaneous flank H358 tumors 100-150 mm³ in volume were treated with one intravenous (i.v.) tail vein injection of siRNA conjugate, while control groups (n=4) of the same mice received one i.v. injection of PBS as a vehicle control. Treatment groups that received cholesterol-siRNA conjugates were dosed at 5 mg/kg (based on the weight of siRNA). Some treatment groups also received cholesterol-peptide conjugates at specified molar peptide:siRNA ratios, where all chol-siRNA and chol-peptide conjugates were mixed together in solution and co-injected. All groups (treatments and controls) were administered a dose volume of 5 mL/kg. Table 58 shows the study design in more detail and gives a cross-reference to the conjugate synthesis and characterization. Mice were sacrificed by $CO_2$ asphyxiation at 24, 72, or 144 h post-dose. 50 mg pieces of tumor, liver, kidneys, and lungs were collected and snap-frozen in liquid nitrogen. mRNA knockdown analysis and siRNA quantitation were performed as described in Examples 2-7.

TABLE 58

Study design for a Cholesterol-siRNA Conjugate
(PK-067) with a cross-reference to the
conjugate synthesis and characterization

| Group | Test Article | N | siRNA Dose (mg/kg) | mol EEP/ mol siRNA Ratio | ROA | # of Doses | Harvest Time (h) | Cross-reference to synthesis and characterization |
|---|---|---|---|---|---|---|---|---|
| 1 | chol-KRAS | 3 | 5 | — | IV | 1 | 24 | General |
| 2 |  | 3 | 5 | — | IV | 1 | 72 | experimental |
| 3 |  | 3 | 5 | — | IV | 1 | 144 | (Example 2) |
| 4 | chol-KRAS + | 3 | 5 | 1 | IV | 1 | 24 | General |
| 5 | chol-Melittin | 3 | 5 | 1 | IV | 1 | 72 | experimental |
| 6 |  | 3 | 5 | 1 | IV | 1 | 144 | (Example 2) |
| 7 | chol-KRAS + | 3 | 5 | 3 | IV | 1 | 24 | General |
| 8 | chol-Melittin | 3 | 5 | 3 | IV | 1 | 72 | experimental |
| 9 |  | 3 | 5 | 3 | IV | 1 | 144 | (Example 2) |
| 10 | chol-KRAS + | 3 | 5 | 10 | IV | 1 | 24 | General |
| 11 | chol-Melittin | 3 | 5 | 10 | IV | 1 | 72 | experimental |
| 12 |  | 3 | 5 | 10 | IV | 1 | 144 | (Example 2) |
| 13 | chol-KRAS + | 3 | 5 | 1 | IV | 1 | 24 | General |
| 14 | chol-INF7 | 3 | 5 | 1 | IV | 1 | 72 | experimental |
| 15 |  | 3 | 5 | 1 | IV | 1 | 144 | (Example 2) |
| 16 | chol-KRAS + | 3 | 5 | 3 | IV | 1 | 24 | General |
| 17 | chol-INF7 | 3 | 5 | 3 | IV | 1 | 72 | experimental |
| 18 |  | 3 | 5 | 3 | IV | 1 | 144 | (Example 2) |
| 19 | chol-KRAS + | 3 | 5 | 10 | IV | 1 | 24 | General |
| 20 | chol-INF7 | 3 | 5 | 10 | IV | 1 | 72 | experimental |
| 21 |  | 3 | 5 | 10 | IV | 1 | 144 | (Example 2) |
| 22 | Vehicle (PBS) | 4 | — | — | IV | 1 | 24 | General |
| 23 |  | 4 | — | — | IV | 1 | 72 | experimental |

TABLE 58-continued

Study design for a Cholesterol-siRNA Conjugate
(PK-067) with a cross-reference to the
conjugate synthesis and characterization

| Group | Test Article | N | siRNA Dose (mg/kg) | mol EEP/ mol siRNA Ratio | ROA | # of Doses | Harvest Time (h) | Cross-reference to synthesis and characterization |
|---|---|---|---|---|---|---|---|---|
| 24 | | 4 | — | — | IV | 1 | 144 | (Example 2) |
| Total # of Animals: | | 75 | nu/nu mice with H358 tumors | | | | | |

Figure 38A:
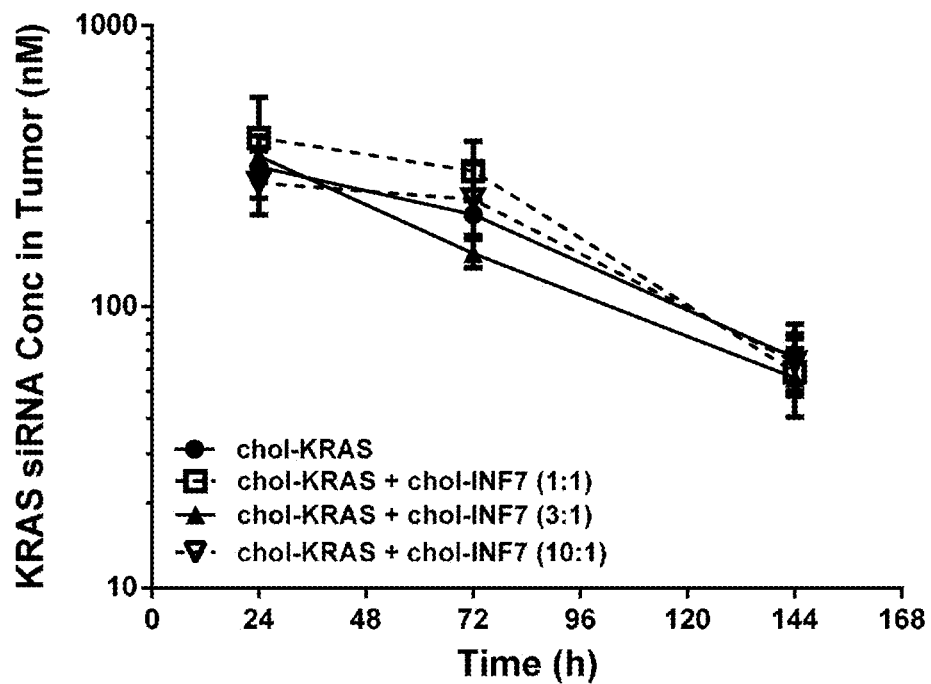
FIG. 38A and FIG. 38B illustrate tissue concentration-time profiles out to 144 h post-dose measured in human s.c. flank H358 tumors for chol-KRAS mixed with either chol-INF7 peptide (FIG. 38A) or chol-melittin peptide (FIG. 38B).
Figure 38B:
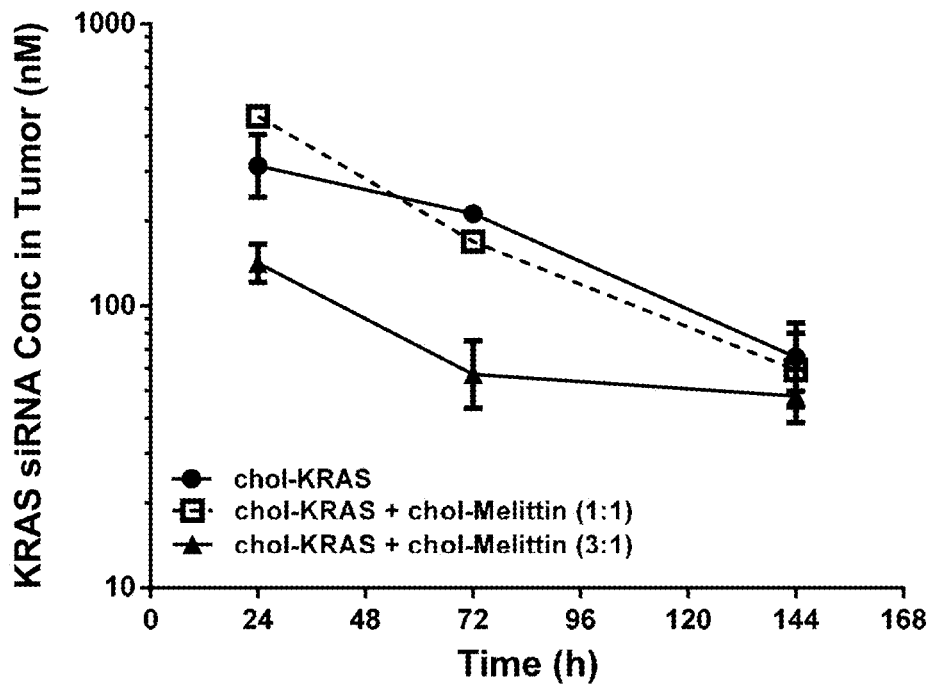
Figure 39A:
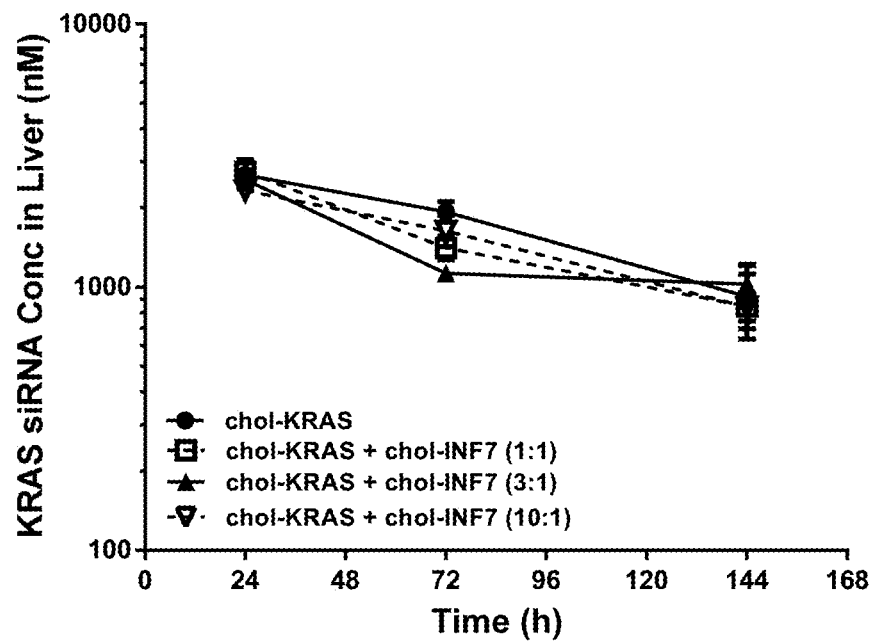
FIG. 39A and FIG. 39B illustrate tissue concentration-time profiles out to 144 h post-dose measured in mouse liver for chol-KRAS mixed with either chol-INF7 peptide (FIG. 39A) or chol-melittin peptide (FIG. 39B).
Figure 39B:
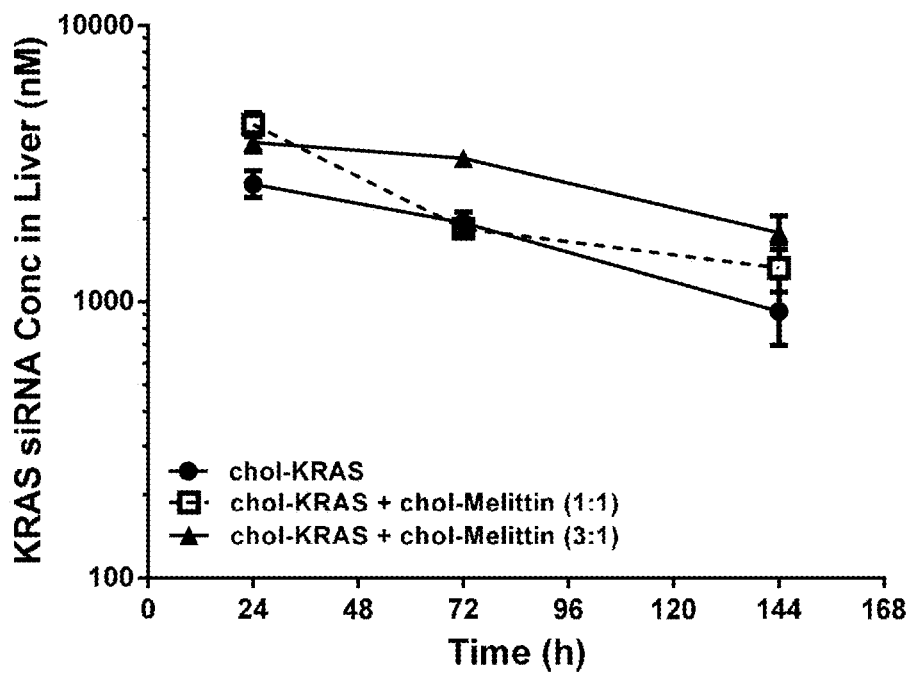
Figure 40A:
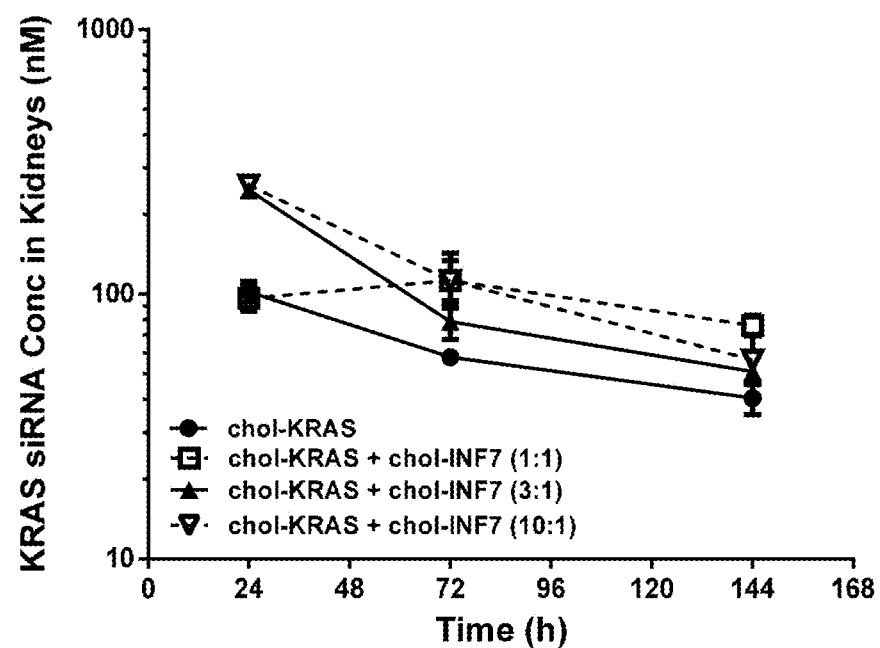
FIG. 40A and FIG. 40B illustrate tissue concentration-time profiles out to 144 h post-dose measured in mouse kidneys for chol-KRAS mixed with either chol-INF7 peptide (FIG. 40A) or chol-melittin peptide (FIG. 40B).
Figure 40B:
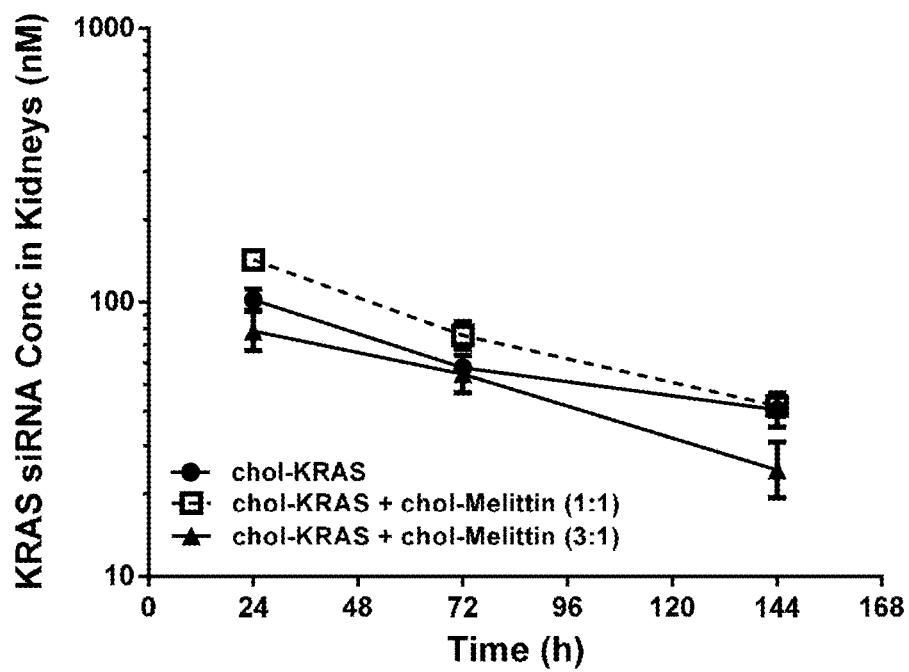
Figure 41A:
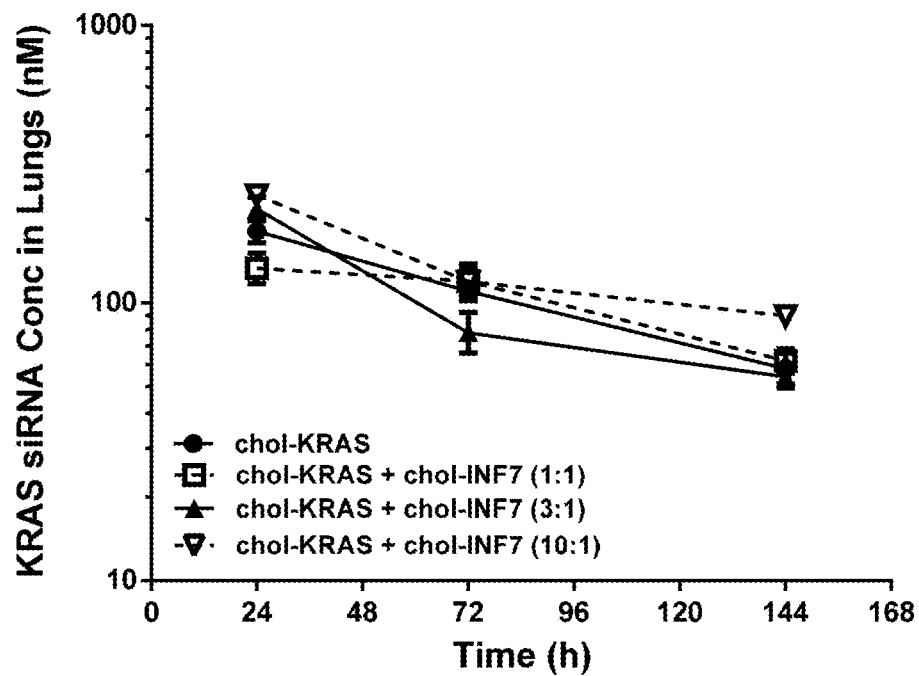
FIG. 41A and FIG. 41B illustrate tissue concentration-time profiles out to 144 h post-dose measured in mouse lungs for chol-KRAS mixed with either chol-INF7 peptide (FIG. 41A) or chol-melittin peptide (FIG. 41B).
Figure 41B:
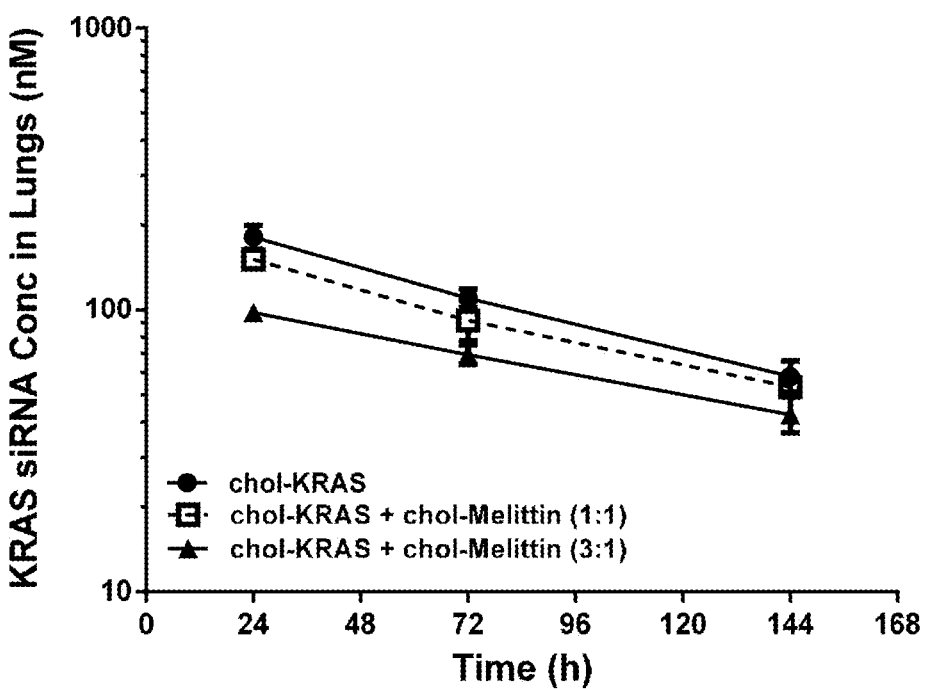
Figure 42:
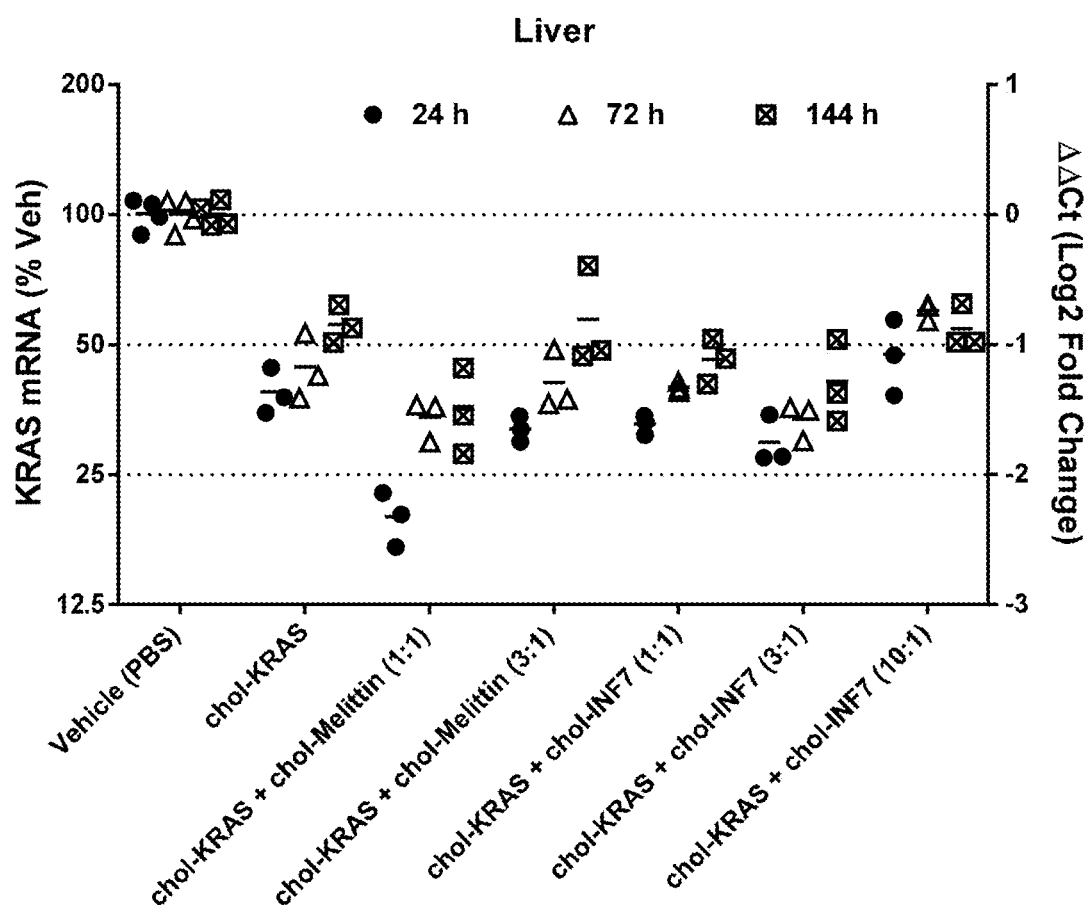
FIG. 42 illustrates siRNA-mediated mRNA knockdown of mouse KRAS in mouse liver.

Endosomolytic moieties (EEPs) such as INF7 and melittin were conjugated to cholesterol, mixed with chol-siRNA, and then co-injected into mice to demonstrate an increase in siRNA potency due to the improved endosomal escape. First, the effect of adding the EEPs on the siRNA concentration in various tissues was assessed. As illustrated in FIG. 38A, the addition of chol-INF7 at any of the molar ratios of EEP:siRNA did not affect the siRNA tumor PK. However, as illustrated in FIG. 38B, the addition of chol-melittin at a 1:1 ratio did not affect the tumor PK but the addition of chol-melittin at a 3:1 EEP:siRNA ratio decreased the amount of siRNA in tumor. As illustrated in FIG. 39, neither chol-INF7 nor chol-melittin had much of an impact on the liver PK. Similarly, as illustrated in FIGS. 40 and 41, the chol-INF7 and chol-melittin also did not have much of an impact on the PK profile in kidneys and lungs. Finally, the effect of the chol-EEP conjugates on mRNA KD was assessed and, as shown in FIG. 42, the baseline level of knockdown for chol-KRAS alone was approximately 50%. The addition of 1:1 chol-melittin or 3:1 chol-INF7 improves the knockdown at each time point, due to improved endosomal escape.

In Vivo Study a Cholesterol-siRNA Conjugate (PK-076).

Groups (n=5) of female NCr nu/nu mice bearing subcutaneous flank H358 tumors 100-150 mm$^3$ in volume were treated with three intravenous (i.v.) tail vein injections of siRNA conjugate separated by 48 h, while control groups (n=5) of the same mice received three i.v. injections of PBS as a vehicle control on the same dosing schedule. Treatment groups that received cholesterol-siRNA conjugates were dosed at 5 mg/kg (based on the weight of siRNA). Some treatment groups also received cholesterol-peptide conjugates at specified molar peptide:siRNA ratios, where all chol-siRNA and chol-peptide conjugates were mixed together in solution and co-injected. All groups (treatments and controls) were administered a dose volume of 5 mL/kg. Table 59 describes the study design in more detail and gives a cross-reference to the conjugate synthesis and characterization. Mice were sacrificed by $CO_2$ asphyxiation at 24 or 96 h post-dose. 50 mg pieces of tumor, liver, kidneys, and lungs were collected and snap-frozen in liquid nitrogen. mRNA knockdown analysis and siRNA quantitation were performed as described in Examples 2-7.

TABLE 59

Study design for a Cholesterol-siRNA Conjugate
(PK-076) with a cross-reference to the synthesis
and characterization of the conjugates tested.

| Group | Test Article | N | siRNA Dose (mg/kg) | EEP/ siRNA Ratio (mol/mol) | ROA | # of Doses | Harvest Time (h) | Cross-reference to synthesis and characterization |
|---|---|---|---|---|---|---|---|---|
| 1 | chol-KRAS | 5 | 5 | — | IV | 3 | 24 | General |
| 2 | | 5 | 5 | — | IV | 3 | 96 | experimental (Example 2) |
| 3 | chol-KRAS + | 5 | 5 | 1 | IV | 3 | 24 | General |
| 4 | chol-melittin (1:1) | 5 | 5 | 1 | IV | 3 | 96 | experimental (Example 2) |
| 5 | chol-KRAS + | 5 | 5 | 3 | IV | 3 | 24 | General |
| 6 | chol-INF7 (3:1) | 5 | 5 | 3 | IV | 3 | 96 | experimental (Example 2) |
| 7 | Vehicle | 5 | — | — | IV | 3 | 24 | |
| 8 | | 5 | — | — | IV | 3 | 96 | |

Figure 43A:
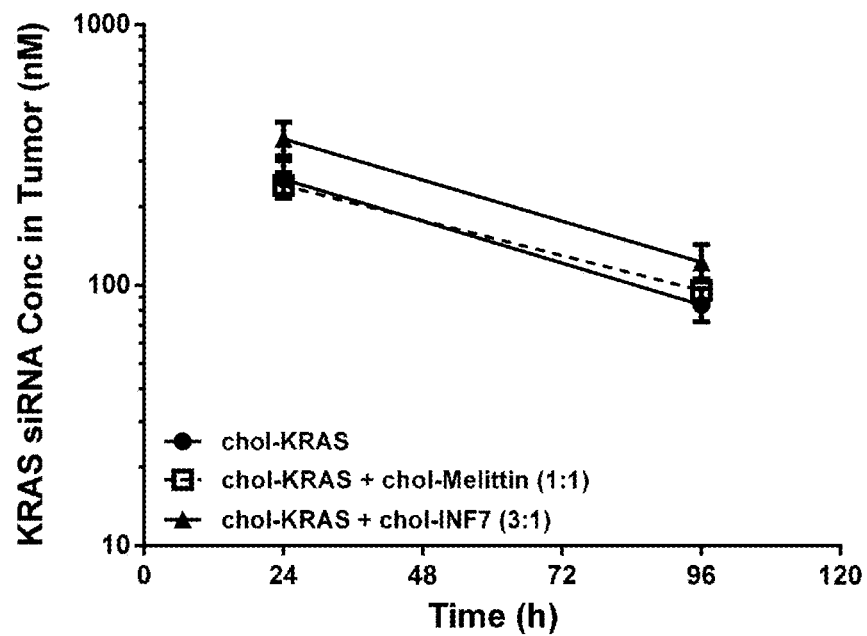
FIG. 43A and FIG. 43B illustrate tissue concentration-time profiles out to 96 h post-dose measured in human s.c. flank H358 tumors (FIG. 43A) or mouse liver (FIG. 43B).
Figure 43B:
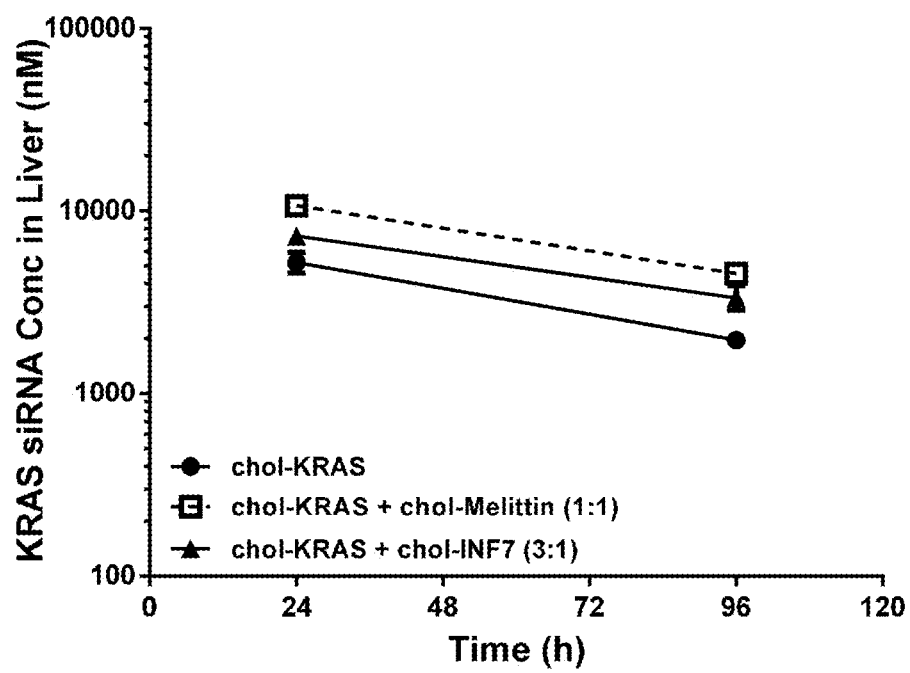
Figure 44A:
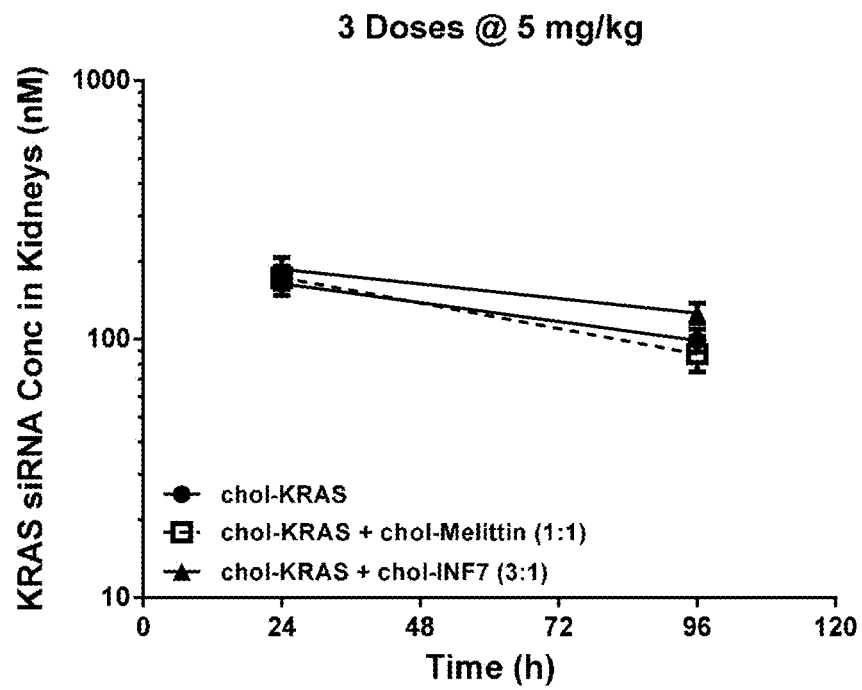
FIG. 44A and FIG. 44B show tissue concentration-time profiles out to 96 h post-dose measured in mouse kidneys (FIG. 44A) or mouse lungs (FIG. 44B).
Figure 44B:
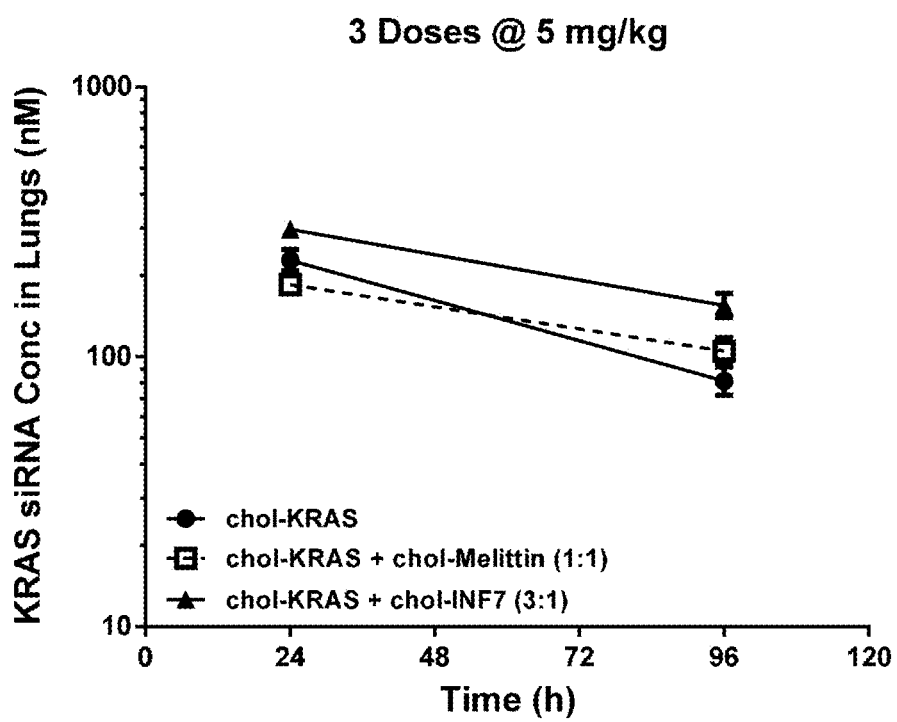

The activity seen in the single-dose study with chol-siRNA and chol-EEP was followed up with a three dose study. The 3:1 ratio of EEP:siRNA was selected for INF7, and the 1:1 ratio was selected for melittin. As illustrated in FIG. 43 and FIG. 44, the addition of either chol-EEP to the chol-siRNA does not seem to greatly affect the tissue PK following three doses. As for the knockdown, FIG. 45 shows that addition of chol-melittin clearly improves tumor knockdown 24 h post-dose. It also shows that chol-melittin improves tumor knockdown at 96 h post-dose.

In Vivo Study a Cholesterol-siRNA Conjugate (PK-079).

Figure 47A:
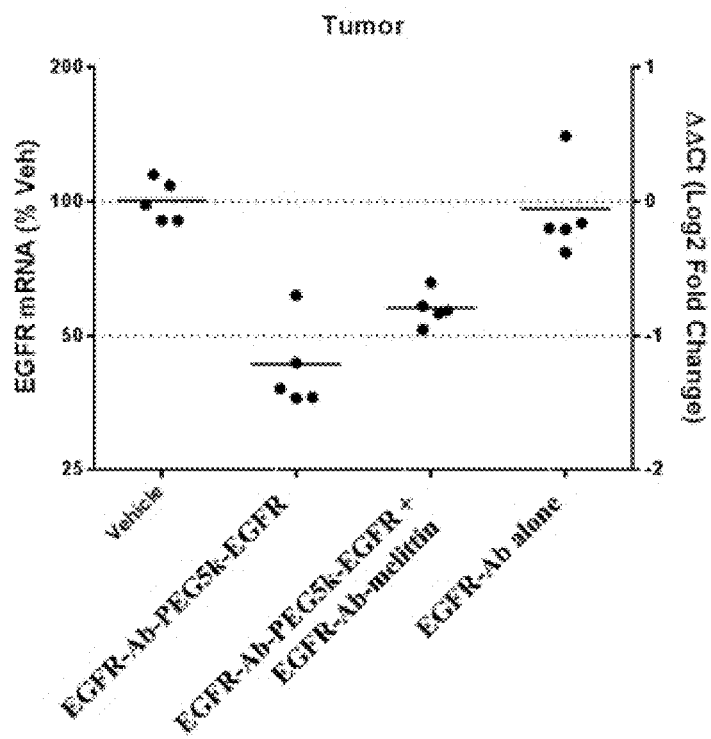
FIG. 47A and FIG. 47B show siRNA-mediated mRNA knockdown in human s.c. flank H358 tumors of EGFR (FIG. 47A) or KRAS (FIG. 47B).
Figure 47B:
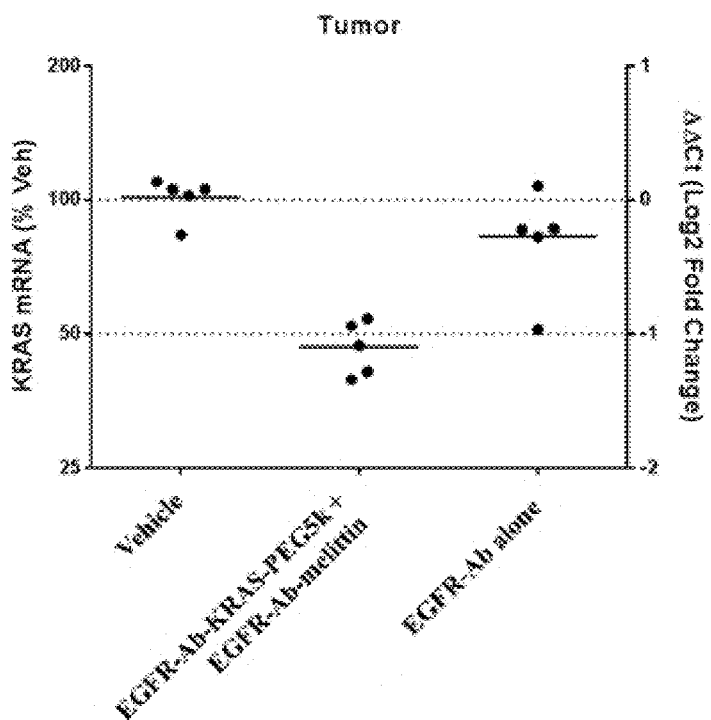

Groups (n=5) of female NCr nu/nu mice bearing subcutaneous flank H358 tumors 100-150 mm$^3$ in volume were treated with one intravenous (i.v.) tail vein injection of siRNA conjugate, while control groups (n=5) of the same mice received one i.v. injection of PBS as a vehicle control. Treatment groups that received EGFR antibody-siRNA-PEG conjugates were dosed at 0.5 mg/kg (based on the weight of siRNA) and groups that also received EGFR antibody-melittin had the dose of EGFR-Ab matched between EGFR antibody-siRNA and EGFR antibody-melittin. All groups (treatments and controls) were administered a dose volume of 5 mL/kg. Table 60 describes the study design in more detail and gives a cross-reference to the conjugate synthesis and characterization. Mice were sacrificed by $CO_2$ asphyxiation at 96 h post-dose. 50 mg pieces of tumor, liver, kidney, and lung were collected and snap-frozen in liquid nitrogen. mRNA knockdown analysis and siRNA quantitation were performed as described in Examples 2-7.

mg/kg of EGFR antibody-siRNA conjugate was able to deliver approximate 100 nM concentrations of siRNA into tumor with both configurations of the conjugate. The addition of EGFR antibody-melittin did not appear to impact the tissue PK. Out of the four tissues analyzed, tumor had the highest concentration and liver the second highest, with kidneys and lungs showing low uptake of siRNA. As illustrated in FIG. 47, the strong siRNA delivery to tumor once again translated into approximately 50% knockdown of EGFR or KRAS in the tumors. Free EGFR-Ab, run as a control group, showed no mRNA knockdown as did the PBS control.

In Vivo Study a Cholesterol-siRNA Conjugate (PD-077).

Groups (n=11) of female NCr nu/nu mice bearing intrahepatic Hep3B tumors one week after inoculation were treated with nine intravenous (i.v.) or subcutaneous (s.c.) injections (TIW) of cholesterol-siRNA conjugate, while control groups (n=11) of the same mice received nine i.v. tail vein injections of PBS as a vehicle control (also dosed TIW). Treatment groups that received chol-CTNNB1 were dosed at 5 mg/kg. All groups (treatments and controls) were administered a dose volume of 6.25 mL/kg. Table 61 describes the study design in more detail and gives a cross-reference to the conjugate synthesis and characterization. Non-terminal blood samples were collected once per week via puncture of the retro-orbital plexus and processed to generate serum for alpha-Fetoprotein (AFP) measurement. Mice were sacrificed by $CO_2$ asphyxiation at 24 h post-final dose. 50 mg pieces of tumor-bearing liver were collected and snap-frozen in liquid nitrogen. mRNA knockdown analysis was performed as described above. AFP was quantified using the Human alpha-Fetoprotein DuoSet ELISA kit (R&D Systems) according to the manufacturer's instructions.

TABLE 60

Study design for a Cholesterol-siRNA Conjugate (PK-079) with a cross-reference to the synthesis and characterization of the conjugates tested.

| Group | Test Article | N | siRNA Dose (mg/kg) | siRNA: EGFR-Ab Ratio (mol/mol) | melittin: siRNA Ratio (mol/mol) | ROA | # of Doses | Harvest Time (h) | Cross-reference to synthesis and characterization |
|---|---|---|---|---|---|---|---|---|---|
| 1 | EGFR-Ab-PEG5k-EGFR | 5 | 0.5 | 1 | — | IV | 1 | 96 | Example 4 |
| 2 | EGFR-Ab-PEG5k-EGFR + EGFR-Ab-melittin | 5 | 0.5 | 1 | 1:1 | IV | 1 | 96 | Example 3 and 6 |
| 3 | EGFR-Ab-KRAS-PEG5k + EGFR-Ab-melittin | 5 | 0.5 | 1 | 1:1 | IV | 1 | 96 | Example 3 and 6 |
| 4 | EGFR antibody Alone | 5 | — | — | — | IV | 1 | 96 | General experimental (Example 2) |
| 5 | Vehicle | 5 | — | — | — | IV | 1 | 96 | |

Figure 46:
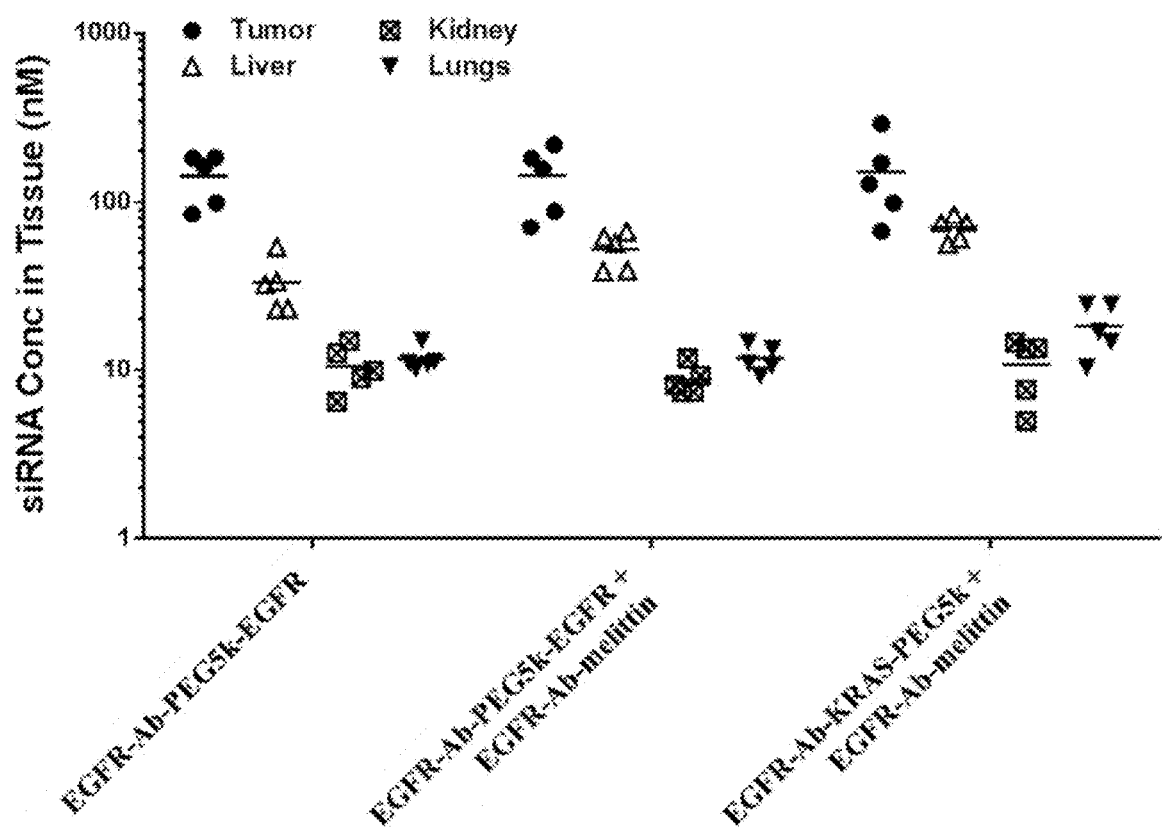
FIG. 46 shows tissue concentrations of siRNA at 96 h post-dose measured in human s.c. flank H358 tumors and mouse liver, kidneys, and lungs.

The PK/PD relationship for EGFR antibody-siRNA conjugates to deliver siRNA to tumor and produce mRNA knockdown in tumor was evaluated for reproducibility. As illustrated in FIG. 46, once again a single i.v. dose of 0.5

TABLE 61

Study design for a Cholesterol-siRNA Conjugate
(PK-077) with a cross-reference to the synthesis
and characterization of the conjugates tested.

| Group | Test Article | N | siRNA Dose (mg/kg) | ROA | # of Doses | Survival Bleed (min) | Terminal Bleed (h) | Cross-reference to synthesis and characterization |
|---|---|---|---|---|---|---|---|---|
| 5 | Chol-CTNNB1 | 11 | 5 | IV | 9 | Weekly | 24 | General experimental (Example 2) |
| 8 | Chol-CTNNB1 | 11 | 5 | SC | 9 | Weekly | 24 | General experimental (Example 2) |
| 11 | Vehicle | 11 | | IV | 9 | Weekly | 24 | |
| Total # of Animals: | | 33 | | | | | | |

Figure 48:
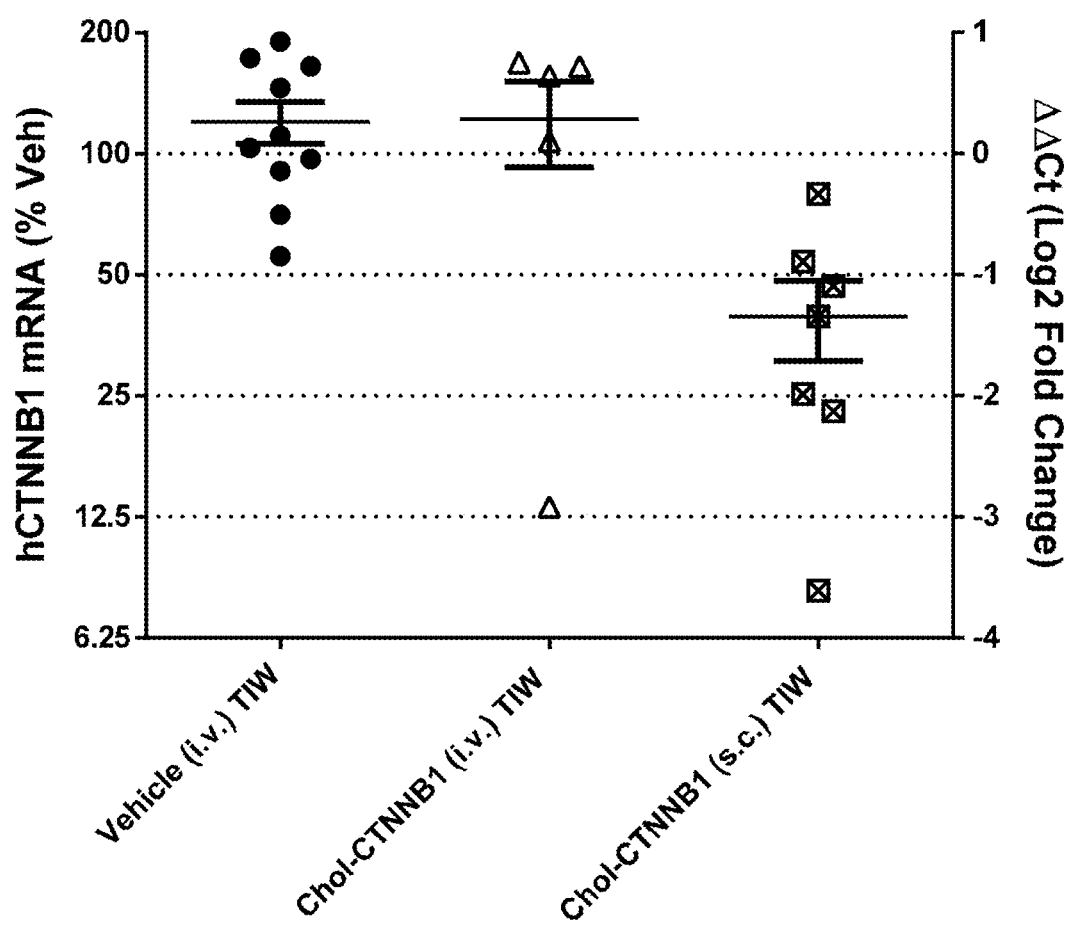
FIG. 48 shows siRNA-mediated mRNA knockdown of human CTNNB1 in Hep3B orthotopic liver tumors.
Figure 49:
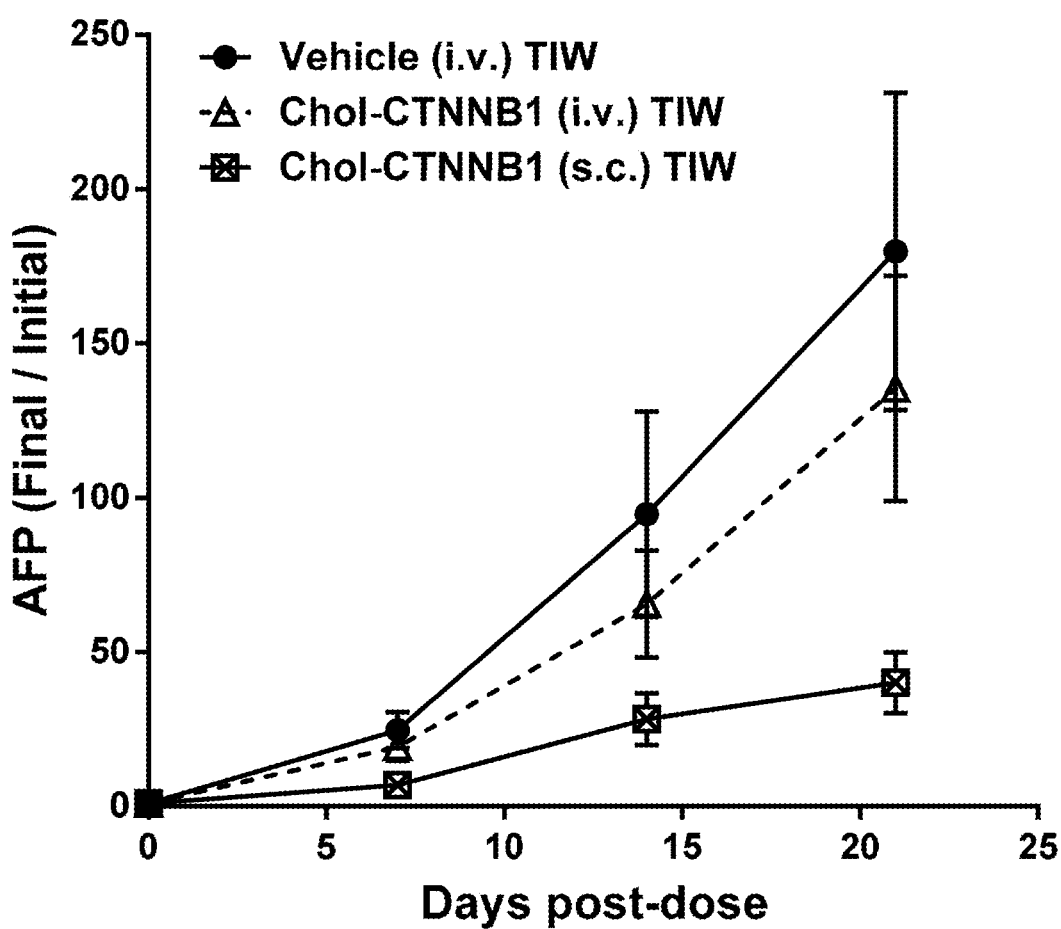
FIG. 49 shows human alpha-Fetoprotein in serum from mice with Hep3B orthotopic liver tumors.

Since earlier studies demonstrated that it was possible for a single dose of chol-siRNA to generate knockdown in normal liver, it was hypothesized that knockdown could be achieved in orthotopic liver tumors as well. Mice were inoculated with intrahepatic Hep3B tumors that were allowed to grow for one week post-inoculation, and then these mice were administered 5 mg/kg doses of chol-CTNNB1 (either i.v. or s.c.) three times a week for three weeks (9 total doses). As illustrated in FIG. 48, the chol-CTNNB1 dosed s.c. was able to produce >50% mRNA knockdown at the harvest time point of 24 h post-final dose. In contrast, the chol-CTNNB1 siRNA that was dosed i.v. does not seem to show any mRNA knockdown at this time point (although some mice did not have any measurable human CTNNB1 signal, it was hard to determine if the loss of signal was related to knockdown or low tumor burden). The human Hep3B cells are also known to secrete human alpha-Fetoprotein (AFP), and it is known that the amount of secreted AFP correlates with the number of Hep3B cells. Thus, the concentration of AFP in serum is taken as a marker of tumor load in the mouse, and the increase in AFP over time correlates with tumor growth. As illustrated in FIG. 49, the chol-CTNNB1 dosed s.c. markedly reduced the AFP levels in those mice, which provides evidence that the CTNNB1 mRNA knockdown led to the inhibition of tumor growth.

Example 46. Liver PK/PD Study

Female wild-type CD-1 mice will be dosed with chol-siRNA-EEP conjugates at 5 mg/kg (based on the weight of siRNA). In these studies the siRNA used will be against the mouse Factor VII (FVII) such that FVII knockdown can be determined by measuring the FVII protein levels in plasma. Multiple EEPs (endosomolytic moieties) will be used to determine the peptide sequence that demonstrates optimal endosomal escape, resulting in the best knockdown of the FVII target gene relative to the control.

Example 47. Tumor PK/PD Study

Female NCr nu/nu mice bearing subcutaneous flank H358 tumors will be dosed with EGFR antibody-siRNA-EEP conjugates at 0.5 mg/kg (based on siRNA). Multiple EEPs (endosomolytic moieties) will be used to determine the peptide sequence that demonstrates optimal endosomal escape, resulting in the best knockdown of the target gene relative to the control.

Example 48. Formulation of an ABC Conjugate with Nanoparticles

An exemplary ABC conjugate is packaged into self-assembled nanoparticles using cyclodextrin polymers (10 kDa) and an excess of non-conjugated siRNAs (ED 40-60 nm, PDI 0.1-0.2). In these particles, the exemplary ABC conjugate maintains its ability to interact with the antibody target. The stability and target binding competency of the particles in circulation in vivo is regulated through modifications of the packaging siRNAs.

Nanoparticle Formation

Nanoparticles are prepared at a final siRNA concentration of 1.6 mg/mL. siRNA containing CY5-siRNA at a ratio of 1:20 is first diluted to 2× final concentration in water. Cyclodextrin polymer (CDP) is diluted to 2× final concentration necessary to achieve a nitrogen to phosphorus ratio (N:P) of 3:1 in 10 mM phosphate buffer at neutral pH. CDP is added quickly to siRNA and is further mixed by pipetting. Particles are incubated for at least 15 minutes before dosing or analysis.

In Vitro EGFR Binding

Nanoparticles containing various amount of the exemplary ABC conjugate are diluted into Fetal calf serum to a final concentration of 10 nM and are incubated for 1 h at RT with Protein G Dynabeads (Thermofisher) loaded with 150 nM of a purified EGFR-Fc protein (Sino Biological). Beads are washed twice with PBS containing 0.01% Tween 20 and 0.05% BSA before bead-bound nanoparticles are disrupted with water containing 0.01% Tween 20 and 100 ug/ml heparin. The amount of CY5-siRNA contained in the input, unbound fraction, washes and bead eluate is quantified by fluorescence using a TECAN Infinite M200 Pro (Excitation 635 nm; Emission 675 nm).

CY5-ASC Plasma Quantification

Quantification of nanoparticles in mouse plasma is performed as illustrated in Example 43. The CY5-siRNAs bound to EGFR beads are released by using heparin to compete the electrostatic interactions between CDP and siRNAs.

While preferred embodiments of the present disclosure have been shown and described herein, it will be obvious to those skilled in the art that such embodiments are provided by way of example only. Numerous variations, changes, and substitutions will now occur to those skilled in the art without departing from the disclosure. It should be understood that various alternatives to the embodiments of the disclosure described herein may be employed in practicing the disclosure. It is intended that the following claims define the scope of the disclosure and that methods and structures within the scope of these claims and their equivalents be covered thereby.

SEQUENCE LISTING (2117 sequences)

SEQ ID NO: 1 - RNA, 23 nt, Homo sapiens
aaaugacugaauauaaacuugug

SEQ ID NO: 2 - RNA, 23 nt, Homo sapiens
aaugacugaauauaaacuugugg

SEQ ID NO: 3 - RNA, 23 nt, Homo sapiens
aacuugugguaguuggagcuggu

SEQ ID NO: 4 - RNA, 23 nt, Homo sapiens
uaggcaagagugccuugacgaua

SEQ ID NO: 5 - RNA, 23 nt, Homo sapiens
ggcaagagugccuugacgauaca

SEQ ID NO: 6 - RNA, 23 nt, Homo sapiens
gcaagagugccuugacgauacag

SEQ ID NO: 7 - RNA, 23 nt, Homo sapiens
caagagugccuugacgauacagc

SEQ ID NO: 8 - RNA, 23 nt, Homo sapiens
agugccuugacgauacagcuaau

SEQ ID NO: 9 - RNA, 23 nt, Homo sapiens
gugccuugacgauacagcuaauu

SEQ ID NO: 10 - RNA, 23 nt, Homo sapiens
ccuugacgauacagcuaauucag

SEQ ID NO: 11 - RNA, 23 nt, Homo sapiens
cuugacgauacagcuaauucaga

SEQ ID NO: 12 - RNA, 23 nt, Homo sapiens
uacagcuaauucagaaucauuuu

SEQ ID NO: 13 - RNA, 23 nt, Homo sapiens
uuguggacgaauaugauccaaca

SEQ ID NO: 14 - RNA, 23 nt, Homo sapiens
uggacgaauaugauccaacaaua

SEQ ID NO: 15 - RNA, 23 nt, Homo sapiens
ggacgaauaugauccaacaauag

SEQ ID NO: 16 - DNA, 21 bp, Artificial Sequence
  Description of Artificial Sequence: Synthetic oligonucleotide
  Description of Combined DNA/RNA Molecule: Synthetic oligonucleotide
augacugaauauaaacuugtt

SEQ ID NO: 17 - DNA, 21 bp, Artificial Sequence
  Description of Artificial Sequence: Synthetic oligonucleotide
  Description of Combined DNA/RNA Molecule: Synthetic oligonucleotide
caaguuuauauucagucautt

SEQ ID NO: 18 - DNA, 21 bp, Artificial Sequence
  Description of Artificial Sequence: Synthetic oligonucleotide
  Description of Combined DNA/RNA Molecule: Synthetic oligonucleotide
ugacugaauauaaacuugutt

SEQ ID NO: 19 - DNA, 21 bp, Artificial Sequence
  Description of Artificial Sequence: Synthetic oligonucleotide
  Description of Combined DNA/RNA Molecule: Synthetic oligonucleotide
acaaguuuauauucagucatt

SEQ ID NO: 20 - DNA, 21 bp, Artificial Sequence
  Description of Artificial Sequence: Synthetic oligonucleotide
  Description of Combined DNA/RNA Molecule: Synthetic oligonucleotide
cuugugguaguuggagcugtt

SEQ ID NO: 21 - DNA, 21 bp, Artificial Sequence
  Description of Artificial Sequence: Synthetic oligonucleotide
  Description of Combined DNA/RNA Molecule: Synthetic oligonucleotide
cagcuccaacuaccacaagtt

SEQ ID NO: 22 - DNA, 21 bp, Artificial Sequence
  Description of Artificial Sequence: Synthetic oligonucleotide
  Description of Combined DNA/RNA Molecule: Synthetic oligonucleotide
ggcaagagugccuugacgatt

SEQ ID NO: 23 - DNA, 21 bp, Artificial Sequence
  Description of Artificial Sequence: Synthetic oligonucleotide
  Description of Combined DNA/RNA Molecule: Synthetic oligonucleotide
ucgucaaggcacucuugcctt

SEQ ID NO: 24 - DNA, 21 bp, Artificial Sequence
  Description of Artificial Sequence: Synthetic oligonucleotide
  Description of Combined DNA/RNA Molecule: Synthetic oligonucleotide
caagagugccuugacgauatt

SEQ ID NO: 25 - DNA, 21 bp, Artificial Sequence
  Description of Artificial Sequence: Synthetic oligonucleotide
  Description of Combined DNA/RNA Molecule: Synthetic oligonucleotide
uaucgucaaggcacucuugtt

SEQ ID NO: 26 - DNA, 21 bp, Artificial Sequence
  Description of Artificial Sequence: Synthetic oligonucleotide
  Description of Combined DNA/RNA Molecule: Synthetic oligonucleotide
aagagugccuugacgauactt

SEQ ID NO: 27 - DNA, 21 bp, Artificial Sequence
  Description of Artificial Sequence: Synthetic oligonucleotide
  Description of Combined DNA/RNA Molecule: Synthetic oligonucleotide
guaucgucaaggcacucuutt

SEQ ID NO: 28 - DNA, 21 bp, Artificial Sequence
  Description of Artificial Sequence: Synthetic oligonucleotide
  Description of Combined DNA/RNA Molecule: Synthetic oligonucleotide
agagugccuugacgauacatt

SEQ ID NO: 29 - DNA, 21 bp, Artificial Sequence
  Description of Artificial Sequence: Synthetic oligonucleotide
  Description of Combined DNA/RNA Molecule: Synthetic oligonucleotide
uguaucgucaaggcacucutt

SEQ ID NO: 30 - DNA, 21 bp, Artificial Sequence
  Description of Artificial Sequence: Synthetic oligonucleotide
  Description of Combined DNA/RNA Molecule: Synthetic oligonucleotide
ugccuugacgauacagcuatt

SEQ ID NO: 31 - DNA, 21 bp, Artificial Sequence
  Description of Artificial Sequence: Synthetic oligonucleotide
  Description of Combined DNA/RNA Molecule: Synthetic oligonucleotide
uagcuguaucgucaaggcatt

SEQ ID NO: 32 - DNA, 21 bp, Artificial Sequence
  Description of Artificial Sequence: Synthetic oligonucleotide
  Description of Combined DNA/RNA Molecule: Synthetic oligonucleotide
gccuugacgauacagcuaatt

SEQ ID NO: 33 - DNA, 21 bp, Artificial Sequence
  Description of Artificial Sequence: Synthetic oligonucleotide
  Description of Combined DNA/RNA Molecule: Synthetic oligonucleotide
uuagcuguaucgucaaggctt

SEQ ID NO: 34 - DNA, 21 bp, Artificial Sequence
  Description of Artificial Sequence: Synthetic oligonucleotide
  Description of Combined DNA/RNA Molecule: Synthetic oligonucleotide
uugacgauacagcuaauuctt

SEQ ID NO: 35 - DNA, 21 bp, Artificial Sequence
  Description of Artificial Sequence: Synthetic oligonucleotide
  Description of Combined DNA/RNA Molecule: Synthetic oligonucleotide
gaauuagcuguaucgucaatt

SEQ ID NO: 36 - DNA, 21 bp, Artificial Sequence
  Description of Artificial Sequence: Synthetic oligonucleotide
  Description of Combined DNA/RNA Molecule: Synthetic oligonucleotide
ugacgauacagcuaauucatt

SEQ ID NO: 37 - DNA, 21 bp, Artificial Sequence
  Description of Artificial Sequence: Synthetic oligonucleotide
  Description of Combined DNA/RNA Molecule: Synthetic oligonucleotide
ugaauuagcuguaucgucatt

SEQ ID NO: 38 - DNA, 21 bp, Artificial Sequence
  Description of Artificial Sequence: Synthetic oligonucleotide
  Description of Combined DNA/RNA Molecule: Synthetic oligonucleotide
cagcuaauucagaaucauutt

SEQ ID NO: 39 - DNA, 21 bp, Artificial Sequence
  Description of Artificial Sequence: Synthetic oligonucleotide
  Description of Combined DNA/RNA Molecule: Synthetic oligonucleotide
aaugauucugaauuagcugtt

SEQ ID NO: 40 - DNA, 21 bp, Artificial Sequence
  Description of Artificial Sequence: Synthetic oligonucleotide
  Description of Combined DNA/RNA Molecule: Synthetic oligonucleotide
guggacgaauaugauccaatt

SEQ ID NO: 41 - DNA, 21 bp, Artificial Sequence
  Description of Artificial Sequence: Synthetic oligonucleotide
  Description of Combined DNA/RNA Molecule: Synthetic oligonucleotide
uuggaucauauucguccactt

SEQ ID NO: 42 - DNA, 21 bp, Artificial Sequence
  Description of Artificial Sequence: Synthetic oligonucleotide
  Description of Combined DNA/RNA Molecule: Synthetic oligonucleotide
gacgaauaugauccaacaatt

SEQ ID NO: 43 - DNA, 21 bp, Artificial Sequence
  Description of Artificial Sequence: Synthetic oligonucleotide
  Description of Combined DNA/RNA Molecule: Synthetic oligonucleotide
uuguuggaucauauucguctt

SEQ ID NO: 44 - DNA, 21 bp, Artificial Sequence
  Description of Artificial Sequence: Synthetic oligonucleotide
  Description of Combined DNA/RNA Molecule: Synthetic oligonucleotide
acgaauaugauccaacaautt

SEQ ID NO: 45 - DNA, 21 bp, Artificial Sequence
  Description of Artificial Sequence: Synthetic oligonucleotide
  Description of Combined DNA/RNA Molecule: Synthetic oligonucleotide
auuguuggaucauauucgutt

SEQ ID NO: 46 - DNA, 21 bp, Artificial Sequence
  Description of Artificial Sequence: Synthetic oligonucleotide
  Description of Combined DNA/RNA Molecule: Synthetic oligonucleotide
augacugaauauaaacuugtt

SEQ ID NO: 47 - DNA, 21 bp, Artificial Sequence
  Description of Artificial Sequence: Synthetic oligonucleotide
  Description of Combined DNA/RNA Molecule: Synthetic oligonucleotide
caaguuuauauucagucautt

SEQ ID NO: 48 - DNA, 21 bp, Artificial Sequence
  Description of Artificial Sequence: Synthetic oligonucleotide
  Description of Combined DNA/RNA Molecule: Synthetic oligonucleotide
ugacugaauauaaacuugutt

SEQ ID NO: 49 - DNA, 21 bp, Artificial Sequence
  Description of Artificial Sequence: Synthetic oligonucleotide
  Description of Combined DNA/RNA Molecule: Synthetic oligonucleotide
acaaguuuauauucagucatt

SEQ ID NO: 50 - DNA, 21 bp, Artificial Sequence
  Description of Artificial Sequence: Synthetic oligonucleotide
  Description of Combined DNA/RNA Molecule: Synthetic oligonucleotide
cuugugguaguuggagcugtt

SEQ ID NO: 51 - DNA, 21 bp, Artificial Sequence
  Description of Artificial Sequence: Synthetic oligonucleotide
  Description of Combined DNA/RNA Molecule: Synthetic oligonucleotide
cagcuccaacuaccacaagtt

SEQ ID NO: 52 - DNA, 21 bp, Artificial Sequence
  Description of Artificial Sequence: Synthetic oligonucleotide
  Description of Combined DNA/RNA Molecule: Synthetic oligonucleotide
ggcaagagugccuugacgatt

SEQ ID NO: 53 - DNA, 21 bp, Artificial Sequence
  Description of Artificial Sequence: Synthetic oligonucleotide
  Description of Combined DNA/RNA Molecule: Synthetic oligonucleotide
ucgucaaggcacucuugcctt

SEQ ID NO: 54 - DNA, 21 bp, Artificial Sequence
  Description of Artificial Sequence: Synthetic oligonucleotide
  Description of Combined DNA/RNA Molecule: Synthetic oligonucleotide
caagagugccuugacgauatt

SEQ ID NO: 55 - DNA, 21 bp, Artificial Sequence
  Description of Artificial Sequence: Synthetic oligonucleotide
  Description of Combined DNA/RNA Molecule: Synthetic oligonucleotide
uaucgucaaggcacucuugtt

SEQ ID NO: 56 - DNA, 21 bp, Artificial Sequence
  Description of Artificial Sequence: Synthetic oligonucleotide
  Description of Combined DNA/RNA Molecule: Synthetic oligonucleotide
aagagugccuugacgauactt

SEQ ID NO: 57 - DNA, 21 bp, Artificial Sequence
  Description of Artificial Sequence: Synthetic oligonucleotide
  Description of Combined DNA/RNA Molecule: Synthetic oligonucleotide
guaucgucaaggcacucuutt

SEQ ID NO: 58 - DNA, 21 bp, Artificial Sequence
  Description of Artificial Sequence: Synthetic oligonucleotide
  Description of Combined DNA/RNA Molecule: Synthetic oligonucleotide
agagugccuugacgauacatt

SEQ ID NO: 59 - DNA, 21 bp, Artificial Sequence
  Description of Artificial Sequence: Synthetic oligonucleotide
  Description of Combined DNA/RNA Molecule: Synthetic oligonucleotide
uguaucgucaaggcacucutt

SEQ ID NO: 60 - DNA, 21 bp, Artificial Sequence
  Description of Artificial Sequence: Synthetic oligonucleotide
  Description of Combined DNA/RNA Molecule: Synthetic oligonucleotide
ugccuugacgauacagcuatt

SEQ ID NO: 61 - DNA, 21 bp, Artificial Sequence
  Description of Artificial Sequence: Synthetic oligonucleotide
  Description of Combined DNA/RNA Molecule: Synthetic oligonucleotide
uagcuguaucgucaaggcatt

SEQ ID NO: 62 - DNA, 21 bp, Artificial Sequence
  Description of Artificial Sequence: Synthetic oligonucleotide
  Description of Combined DNA/RNA Molecule: Synthetic oligonucleotide
gccuugacgauacagcuaatt

SEQ ID NO: 63 - DNA, 21 bp, Artificial Sequence
  Description of Artificial Sequence: Synthetic oligonucleotide
  Description of Combined DNA/RNA Molecule: Synthetic oligonucleotide
uuagcuguaucgucaaggctt

SEQ ID NO: 64 - DNA, 21 bp, Artificial Sequence
  Description of Artificial Sequence: Synthetic oligonucleotide
  Description of Combined DNA/RNA Molecule: Synthetic oligonucleotide
uugacgauacagcuaauuctt

SEQ ID NO: 65 - DNA, 21 bp, Artificial Sequence
  Description of Artificial Sequence: Synthetic oligonucleotide
  Description of Combined DNA/RNA Molecule: Synthetic oligonucleotide
gaauuagcuguaucgucaatt

SEQ ID NO: 66 - DNA, 21 bp, Artificial Sequence
  Description of Artificial Sequence: Synthetic oligonucleotide
  Description of Combined DNA/RNA Molecule: Synthetic oligonucleotide
ugacgauacagcuaauucatt

SEQ ID NO: 67 - DNA, 21 bp, Artificial Sequence
  Description of Artificial Sequence: Synthetic oligonucleotide
  Description of Combined DNA/RNA Molecule: Synthetic oligonucleotide
ugaauuagcuguaucgucatt

SEQ ID NO: 68 - DNA, 21 bp, Artificial Sequence
  Description of Artificial Sequence: Synthetic oligonucleotide
  Description of Combined DNA/RNA Molecule: Synthetic oligonucleotide
cagcuaauucagaaucauutt

SEQ ID NO: 69 - DNA, 21 bp, Artificial Sequence
  Description of Artificial Sequence: Synthetic oligonucleotide
  Description of Combined DNA/RNA Molecule: Synthetic oligonucleotide
aaugauucugaauuagcugtt

SEQ ID NO: 70 - DNA, 21 bp, Artificial Sequence
  Description of Artificial Sequence: Synthetic oligonucleotide
  Description of Combined DNA/RNA Molecule: Synthetic oligonucleotide
guggacgaauaugauccaatt

SEQ ID NO: 71 - DNA, 21 bp, Artificial Sequence
  Description of Artificial Sequence: Synthetic oligonucleotide
  Description of Combined DNA/RNA Molecule: Synthetic oligonucleotide
uuggaucauauucguccactt

SEQ ID NO: 72 - DNA, 21 bp, Artificial Sequence
  Description of Artificial Sequence: Synthetic oligonucleotide
  Description of Combined DNA/RNA Molecule: Synthetic oligonucleotide
gacgaauaugauccaacaatt

SEQ ID NO: 73 - DNA, 21 bp, Artificial Sequence
  Description of Artificial Sequence: Synthetic oligonucleotide
  Description of Combined DNA/RNA Molecule: Synthetic oligonucleotide
uuguuggaucauauucguctt

SEQ ID NO: 74 - DNA, 21 bp, Artificial Sequence
  Description of Artificial Sequence: Synthetic oligonucleotide
  Description of Combined DNA/RNA Molecule: Synthetic oligonucleotide
acgaauaugauccaacaautt

SEQ ID NO: 75 - DNA, 21 bp, Artificial Sequence
  Description of Artificial Sequence: Synthetic oligonucleotide
  Description of Combined DNA/RNA Molecule: Synthetic oligonucleotide
auuguuggaucauauucgutt

SEQ ID NO: 76 - RNA, 23 nt, Homo sapiens
ggcggccggagucccgagcuagc

SEQ ID NO: 77 - RNA, 23 nt, Homo sapiens
ggccggagucccgagcuagcccc

SEQ ID NO: 78 - RNA, 23 nt, Homo sapiens
gccggagucccgagcuagccccg

SEQ ID NO: 79 - RNA, 23 nt, Homo sapiens
ccggagucccgagcuagccccgg

SEQ ID NO: 80 - RNA, 23 nt, Homo sapiens
cggagucccgagcuagccccggc

SEQ ID NO: 81 - RNA, 23 nt, Homo sapiens
ggagucccgagcuagccccggcg

SEQ ID NO: 82 - RNA, 23 nt, Homo sapiens
gagucccgagcuagccccggcgg

SEQ ID NO: 83 - RNA, 23 nt, Homo sapiens
gucccgagcuagccccggcggcc

SEQ ID NO: 84 - RNA, 23 nt, Homo sapiens
ccggacgacaggccaccucgucg

SEQ ID NO: 85 - RNA, 23 nt, Homo sapiens
cggacgacaggccaccucgucgg

SEQ ID NO: 86 - RNA, 23 nt, Homo sapiens
ggacgacaggccaccucgucggc

SEQ ID NO: 87 - RNA, 23 nt, Homo sapiens
gacgacaggccaccucgucggcg

SEQ ID NO: 88 - RNA, 23 nt, Homo sapiens
acgacaggccaccucgucggcgu

SEQ ID NO: 89 - RNA, 23 nt, Homo sapiens
gacaggccaccucgucggcgucc

SEQ ID NO: 90 - RNA, 23 nt, Homo sapiens
acaggccaccucgucggcguccg

SEQ ID NO: 91 - RNA, 23 nt, Homo sapiens
caggccaccucgucggcguccgc

SEQ ID NO: 92 - RNA, 23 nt, Homo sapiens
aggccaccucgucggcguccgcc

SEQ ID NO: 93 - RNA, 23 nt, Homo sapiens
ggccaccucgucggcguccgccc

SEQ ID NO: 94 - RNA, 23 nt, Homo sapiens
gccaccucgucggcguccgcccg

SEQ ID NO: 95 - RNA, 23 nt, Homo sapiens
ccaccucgucggcguccgcccga

SEQ ID NO: 96 - RNA, 23 nt, Homo sapiens
caccucgucggcguccgcccgag

SEQ ID NO: 97 - RNA, 23 nt, Homo sapiens
accucgucggcguccgcccgagu

SEQ ID NO: 98 - RNA, 23 nt, Homo sapiens
ccucgucggcguccgcccgaguc

SEQ ID NO: 99 - RNA, 23 nt, Homo sapiens
cucgucggcguccgcccgagucc

SEQ ID NO: 100 - RNA, 23 nt, Homo sapiens
ucgucggcguccgcccgaguccc

SEQ ID NO: 101 - RNA, 23 nt, Homo sapiens
cgucggcguccgcccgagucccc

SEQ ID NO: 102 - RNA, 23 nt, Homo sapiens
cggcguccgcccgaguccccgcc

SEQ ID NO: 103 - RNA, 23 nt, Homo sapiens
ggcguccgcccgaguccccgccu

SEQ ID NO: 104 - RNA, 23 nt, Homo sapiens
ccgcccgaguccccgccucgccg

SEQ ID NO: 105 - RNA, 23 nt, Homo sapiens
ccaacgccacaaccaccgcgcac

SEQ ID NO: 106 - RNA, 23 nt, Homo sapiens
caacgccacaaccaccgcgcacg

SEQ ID NO: 107 - RNA, 23 nt, Homo sapiens
aacgccacaaccaccgcgcacgg

SEQ ID NO: 108 - RNA, 23 nt, Homo sapiens
cgccacaaccaccgcgcacggcc

SEQ ID NO: 109 - RNA, 23 nt, Homo sapiens
gccacaaccaccgcgcacggccc

SEQ ID NO: 110 - RNA, 23 nt, Homo sapiens
ccacaaccaccgcgcacggcccc

SEQ ID NO: 111 - RNA, 23 nt, Homo sapiens
cgaugcgacccuccgggacggcc

SEQ ID NO: 112 - RNA, 23 nt, Homo sapiens
gaugcgacccuccgggacggccg

SEQ ID NO: 113 - RNA, 23 nt, Homo sapiens
augcgacccuccgggacggccgg

SEQ ID NO: 114 - RNA, 23 nt, Homo sapiens
gcgacccuccgggacggccgggg

SEQ ID NO: 115 - RNA, 23 nt, Homo sapiens
cgacccuccgggacggccggggc

SEQ ID NO: 116 - RNA, 23 nt, Homo sapiens
acccuccgggacggccggggcag

SEQ ID NO: 117 - RNA, 23 nt, Homo sapiens
aaagaaaguuugccaaggcacga

SEQ ID NO: 118 - RNA, 23 nt, Homo sapiens
aagaaaguuugccaaggcacgag

SEQ ID NO: 119 - RNA, 23 nt, Homo sapiens
gaaaguuugccaaggcacgagua

SEQ ID NO: 120 - RNA, 23 nt, Homo sapiens
aaaguuugccaaggcacgaguaa

SEQ ID NO: 121 - RNA, 23 nt, Homo sapiens
aaguuugccaaggcacgaguaac

SEQ ID NO: 122 - RNA, 23 nt, Homo sapiens
aguuugccaaggcacgaguaaca

SEQ ID NO: 123 - RNA, 23 nt, Homo sapiens
guuugccaaggcacgaguaacaa

SEQ ID NO: 124 - RNA, 23 nt, Homo sapiens
uuugccaaggcacgaguaacaag

SEQ ID NO: 125 - RNA, 23 nt, Homo sapiens
uugccaaggcacgaguaacaagc

SEQ ID NO: 126 - RNA, 23 nt, Homo sapiens
ucacgcaguugggcacuuuugaa

SEQ ID NO: 127 - RNA, 23 nt, Homo sapiens
cacgcaguugggcacuuuugaag

SEQ ID NO: 128 - RNA, 23 nt, Homo sapiens
acgcaguugggcacuuuugaaga

SEQ ID NO: 129 - RNA, 23 nt, Homo sapiens
cgcaguugggcacuuuugaagau

SEQ ID NO: 130 - RNA, 23 nt, Homo sapiens
gcaguugggcacuuuugaagauc

SEQ ID NO: 131 - RNA, 23 nt, Homo sapiens
caguugggcacuuuugaagauca

SEQ ID NO: 132 - RNA, 23 nt, Homo sapiens
aguugggcacuuuugaagaucau

SEQ ID NO: 133 - RNA, 23 nt, Homo sapiens
guugggcacuuuugaagaucauu

SEQ ID NO: 134 - RNA, 23 nt, Homo sapiens
uugggcacuuuugaagaucauuu

SEQ ID NO: 135 - RNA, 23 nt, Homo sapiens
uuuugaagaucauuuucucagcc

SEQ ID NO: 136 - RNA, 23 nt, Homo sapiens
uugaagaucauuuucucagccuc

SEQ ID NO: 137 - RNA, 23 nt, Homo sapiens
ugaagaucauuuucucagccucc

SEQ ID NO: 138 - RNA, 23 nt, Homo sapiens
aucauuuucucagccuccagagg

SEQ ID NO: 139 - RNA, 23 nt, Homo sapiens
ucagccuccagaggauguucaau

SEQ ID NO: 140 - RNA, 23 nt, Homo sapiens
agccuccagaggauguucaauaa

SEQ ID NO: 141 - RNA, 23 nt, Homo sapiens
gccuccagaggauguucaauaac

SEQ ID NO: 142 - RNA, 23 nt, Homo sapiens
ccagaggauguucaauaacugug

SEQ ID NO: 143 - RNA, 23 nt, Homo sapiens
agaggauguucaauaacugugag

SEQ ID NO: 144 - RNA, 23 nt, Homo sapiens
gauguucaauaacugugaggugg

SEQ ID NO: 145 - RNA, 23 nt, Homo sapiens
uguucaauaacugugaggugguc

SEQ ID NO: 146 - RNA, 23 nt, Homo sapiens
guucaauaacugugagguggucc

SEQ ID NO: 147 - RNA, 23 nt, Homo sapiens
uucaauaacugugaggugguccu

SEQ ID NO: 148 - RNA, 23 nt, Homo sapiens
ucaauaacugugaggugguccuu

SEQ ID NO: 149 - RNA, 23 nt, Homo sapiens
caauaacugugaggugguccuug

SEQ ID NO: 150 - RNA, 23 nt, Homo sapiens
aauaacugugaggugguccuugg

SEQ ID NO: 151 - RNA, 23 nt, Homo sapiens
uaacugugaggugguccuuggga

SEQ ID NO: 152 - RNA, 23 nt, Homo sapiens
acugugaggugguccuugggaau

SEQ ID NO: 153 - RNA, 23 nt, Homo sapiens
cugugaggugguccuugggaauu

SEQ ID NO: 154 - RNA, 23 nt, Homo sapiens
ggugguccuugggaauuuggaaa

SEQ ID NO: 155 - RNA, 23 nt, Homo sapiens
ccuugggaauuuggaaauuaccu

SEQ ID NO: 156 - RNA, 23 nt, Homo sapiens
cuugggaauuuggaaauuaccua

SEQ ID NO: 157 - RNA, 23 nt, Homo sapiens
uugggaauuuggaaauuaccuau

SEQ ID NO: 158 - RNA, 23 nt, Homo sapiens
ugggaauuuggaaauuaccuaug

SEQ ID NO: 159 - RNA, 23 nt, Homo sapiens
gcagaggaauuaugaucuuuccu

SEQ ID NO: 160 - RNA, 23 nt, Homo sapiens
cagaggaauuaugaucuuuccuu

SEQ ID NO: 161 - RNA, 23 nt, Homo sapiens
ggaauuaugaucuuuccuucuua

SEQ ID NO: 162 - RNA, 23 nt, Homo sapiens
gaauuaugaucuuuccuucuuaa

SEQ ID NO: 163 - RNA, 23 nt, Homo sapiens
auuaugaucuuuccuucuuaaag

SEQ ID NO: 164 - RNA, 23 nt, Homo sapiens
uaugaucuuuccuucuuaaagac

SEQ ID NO: 165 - RNA, 23 nt, Homo sapiens
gaucuuuccuucuuaaagaccau

SEQ ID NO: 166 - RNA, 23 nt, Homo sapiens
uuccuucuuaaagaccauccagg

SEQ ID NO: 167 - RNA, 23 nt, Homo sapiens
uccuucuuaaagaccauccagga

SEQ ID NO: 168 - RNA, 23 nt, Homo sapiens
cuucuuaaagaccauccaggagg

SEQ ID NO: 169 - RNA, 23 nt, Homo sapiens
ucuuaaagaccauccaggaggug

SEQ ID NO: 170 - RNA, 23 nt, Homo sapiens
cuuaaagaccauccaggaggugg

SEQ ID NO: 171 - RNA, 23 nt, Homo sapiens
auccaggagguggcugguuaugu

SEQ ID NO: 172 - RNA, 23 nt, Homo sapiens
uccaggagguggcugguuauguc

SEQ ID NO: 173 - RNA, 23 nt, Homo sapiens
ccaggagguggcugguuaugucc

SEQ ID NO: 174 - RNA, 23 nt, Homo sapiens
caggagguggcugguuauguccu

SEQ ID NO: 175 - RNA, 23 nt, Homo sapiens
aggagguggcugguuauguccuc

SEQ ID NO: 176 - RNA, 23 nt, Homo sapiens
ggagguggcugguuauguccuca

SEQ ID NO: 177 - RNA, 23 nt, Homo sapiens
agguggcugguuauguccucauu

SEQ ID NO: 178 - RNA, 23 nt, Homo sapiens
uugcccucaacacaguggagcga

SEQ ID NO: 179 - RNA, 23 nt, Homo sapiens
aauuccuuuggaaaaccugcaga

SEQ ID NO: 180 - RNA, 23 nt, Homo sapiens
auuccuuuggaaaaccugcagau

SEQ ID NO: 181 - RNA, 23 nt, Homo sapiens
uggaaaaccugcagaucaucaga

SEQ ID NO: 182 - RNA, 23 nt, Homo sapiens
ggaaaaccugcagaucaucagag

SEQ ID NO: 183 - RNA, 23 nt, Homo sapiens
aaaaccugcagaucaucagagga

SEQ ID NO: 184 - RNA, 23 nt, Homo sapiens
accugcagaucaucagaggaaau

SEQ ID NO: 185 - RNA, 23 nt, Homo sapiens
acgaaaauuccuaugccuuagca

SEQ ID NO: 186 - RNA, 23 nt, Homo sapiens
cgaaaauuccuaugccuuagcag

SEQ ID NO: 187 - RNA, 23 nt, Homo sapiens
aaaauuccuaugccuuagcaguc

SEQ ID NO: 188 - RNA, 23 nt, Homo sapiens
auuccuaugccuuagcagucuua

SEQ ID NO: 189 - RNA, 23 nt, Homo sapiens
uuccuaugccuuagcagucuuau

SEQ ID NO: 190 - RNA, 23 nt, Homo sapiens
uccuaugccuuagcagucuuauc

SEQ ID NO: 191 - RNA, 23 nt, Homo sapiens
cuaugccuuagcagucuuaucua

SEQ ID NO: 192 - RNA, 23 nt, Homo sapiens
uaugccuuagcagucuuaucuaa

SEQ ID NO: 193 - RNA, 23 nt, Homo sapiens
augccuuagcagucuuaucuaac

SEQ ID NO: 194 - RNA, 23 nt, Homo sapiens
ugccuuagcagucuuaucuaacu

SEQ ID NO: 195 - RNA, 23 nt, Homo sapiens
gccuuagcagucuuaucuaacua

SEQ ID NO: 196 - RNA, 23 nt, Homo sapiens
ccuuagcagucuuaucuaacuau

SEQ ID NO: 197 - RNA, 23 nt, Homo sapiens
cuuagcagucuuaucuaacuaug

SEQ ID NO: 198 - RNA, 23 nt, Homo sapiens
uuagcagucuuaucuaacuauga

SEQ ID NO: 199 - RNA, 23 nt, Homo sapiens
uagcagucuuaucuaacuaugau

SEQ ID NO: 200 - RNA, 23 nt, Homo sapiens
agcagucuuaucuaacuaugaug

SEQ ID NO: 201 - RNA, 23 nt, Homo sapiens
agucuuaucuaacuaugaugcaa

SEQ ID NO: 202 - RNA, 23 nt, Homo sapiens
gucuuaucuaacuaugaugcaaa

SEQ ID NO: 203 - RNA, 23 nt, Homo sapiens
ucuuaucuaacuaugaugcaaau

SEQ ID NO: 204 - RNA, 23 nt, Homo sapiens
cuuaucuaacuaugaugcaaaua

SEQ ID NO: 205 - RNA, 23 nt, Homo sapiens
uuaucuaacuaugaugcaaauaa

SEQ ID NO: 206 - RNA, 23 nt, Homo sapiens
uaucuaacuaugaugcaaauaaa

SEQ ID NO: 207 - RNA, 23 nt, Homo sapiens
aucuaacuaugaugcaaauaaaa

SEQ ID NO: 208 - RNA, 23 nt, Homo sapiens
cuaacuaugaugcaaauaaaacc

SEQ ID NO: 209 - RNA, 23 nt, Homo sapiens
augaugcaaauaaaaccggacug

SEQ ID NO: 210 - RNA, 23 nt, Homo sapiens
ugaugcaaauaaaaccggacuga

SEQ ID NO: 211 - RNA, 23 nt, Homo sapiens
gaugcaaauaaaaccggacugaa

SEQ ID NO: 212 - RNA, 23 nt, Homo sapiens
ugcaaauaaaaccggacugaagg

SEQ ID NO: 213 - RNA, 23 nt, Homo sapiens
gcaaauaaaaccggacugaagga

SEQ ID NO: 214 - RNA, 23 nt, Homo sapiens
caaauaaaaccggacugaaggag

SEQ ID NO: 215 - RNA, 23 nt, Homo sapiens
aauaaaaccggacugaaggagcu

SEQ ID NO: 216 - RNA, 23 nt, Homo sapiens
auaaaaccggacugaaggagcug

SEQ ID NO: 217 - RNA, 23 nt, Homo sapiens
uaaaaccggacugaaggagcugc

SEQ ID NO: 218 - RNA, 23 nt, Homo sapiens
aaaaccggacugaaggagcugcc

SEQ ID NO: 219 - RNA, 23 nt, Homo sapiens
gaaggagcugcccaugagaaauu

SEQ ID NO: 220 - RNA, 23 nt, Homo sapiens
uuuacaggaaauccugcauggcg

SEQ ID NO: 221 - RNA, 23 nt, Homo sapiens
acaggaaauccugcauggcgccg

SEQ ID NO: 222 - RNA, 23 nt, Homo sapiens
caggaaauccugcauggcgccgu

SEQ ID NO: 223 - RNA, 23 nt, Homo sapiens
aggaaauccugcauggcgccgug

SEQ ID NO: 224 - RNA, 23 nt, Homo sapiens
ggaaauccugcauggcgccgugc

SEQ ID NO: 225 - RNA, 23 nt, Homo sapiens
gaaauccugcauggcgccgugcg

SEQ ID NO: 226 - RNA, 23 nt, Homo sapiens
aauccugcauggcgccgugcggu

SEQ ID NO: 227 - RNA, 23 nt, Homo sapiens
uccugcauggcgccgugcgguuc

SEQ ID NO: 228 - RNA, 23 nt, Homo sapiens
ccugcauggcgccgugcgguuca

SEQ ID NO: 229 - RNA, 23 nt, Homo sapiens
cugcauggcgccgugcgguucag

SEQ ID NO: 230 - RNA, 23 nt, Homo sapiens
gcauggcgccgugcgguucagca

SEQ ID NO: 231 - RNA, 23 nt, Homo sapiens
cauggcgccgugcgguucagcaa

SEQ ID NO: 232 - RNA, 23 nt, Homo sapiens
auggcgccgugcgguucagcaac

SEQ ID NO: 233 - RNA, 23 nt, Homo sapiens
uggcgccgugcgguucagcaaca

SEQ ID NO: 234 - RNA, 23 nt, Homo sapiens
ggcgccgugcgguucagcaacaa

SEQ ID NO: 235 - RNA, 23 nt, Homo sapiens
gcgccgugcgguucagcaacaac

SEQ ID NO: 236 - RNA, 23 nt, Homo sapiens
cgccgugcgguucagcaacaacc

SEQ ID NO: 237 - RNA, 23 nt, Homo sapiens
ccgugcgguucagcaacaacccu

SEQ ID NO: 238 - RNA, 23 nt, Homo sapiens
gugcgguucagcaacaacccugc

SEQ ID NO: 239 - RNA, 23 nt, Homo sapiens
gcgguucagcaacaacccugccc

SEQ ID NO: 240 - RNA, 23 nt, Homo sapiens
cagcaacaacccugcccugugca

SEQ ID NO: 241 - RNA, 23 nt, Homo sapiens
gcaacaacccugcccugugcaac

SEQ ID NO: 242 - RNA, 23 nt, Homo sapiens
caacguggagagcauccaguggc

SEQ ID NO: 243 - RNA, 23 nt, Homo sapiens
aacguggagagcauccaguggcg

SEQ ID NO: 244 - RNA, 23 nt, Homo sapiens
acguggagagcauccaguggcgg

SEQ ID NO: 245 - RNA, 23 nt, Homo sapiens
uggagagcauccaguggcgggac

SEQ ID NO: 246 - RNA, 23 nt, Homo sapiens
ggagagcauccaguggcgggaca

SEQ ID NO: 247 - RNA, 23 nt, Homo sapiens
gagagcauccaguggcgggacau

SEQ ID NO: 248 - RNA, 23 nt, Homo sapiens
uccaguggcgggacauagucagc

SEQ ID NO: 249 - RNA, 23 nt, Homo sapiens
ccaguggcgggacauagucagca

SEQ ID NO: 250 - RNA, 23 nt, Homo sapiens
aguggcgggacauagucagcagu

SEQ ID NO: 251 - RNA, 23 nt, Homo sapiens
guggcgggacauagucagcagug

SEQ ID NO: 252 - RNA, 23 nt, Homo sapiens
uucucagcaacaugucgauggac

SEQ ID NO: 253 - RNA, 23 nt, Homo sapiens
cucagcaacaugucgauggacuu

SEQ ID NO: 254 - RNA, 23 nt, Homo sapiens
ucagcaacaugucgauggacuuc

SEQ ID NO: 255 - RNA, 23 nt, Homo sapiens
cagcaacaugucgauggacuucc

SEQ ID NO: 256 - RNA, 23 nt, Homo sapiens
gcaacaugucgauggacuuccag

SEQ ID NO: 257 - RNA, 23 nt, Homo sapiens
caacaugucgauggacuuccaga

SEQ ID NO: 258 - RNA, 23 nt, Homo sapiens
aacaugucgauggacuuccagaa

SEQ ID NO: 259 - RNA, 23 nt, Homo sapiens
acaugucgauggacuuccagaac

SEQ ID NO: 260 - RNA, 23 nt, Homo sapiens
ugucgauggacuuccagaaccac

SEQ ID NO: 261 - RNA, 23 nt, Homo sapiens
cagaaccaccugggcagcugcca

SEQ ID NO: 262 - RNA, 23 nt, Homo sapiens
cugggcagcugccaaaaguguga

SEQ ID NO: 263 - RNA, 23 nt, Homo sapiens
gggcagcugccaaaagugugauc

SEQ ID NO: 264 - RNA, 23 nt, Homo sapiens
gcugccaaaagugugauccaagc

SEQ ID NO: 265 - RNA, 23 nt, Homo sapiens
cugccaaaagugugauccaagcu

SEQ ID NO: 266 - RNA, 23 nt, Homo sapiens
ugccaaaagugugauccaagcug

SEQ ID NO: 267 - RNA, 23 nt, Homo sapiens
caaaagugugauccaagcugucc

SEQ ID NO: 268 - RNA, 23 nt, Homo sapiens
agugugauccaagcugucccaau

SEQ ID NO: 269 - RNA, 23 nt, Homo sapiens
gugugauccaagcugucccaaug

SEQ ID NO: 270 - RNA, 23 nt, Homo sapiens
gugauccaagcugucccaauggg

SEQ ID NO: 271 - RNA, 23 nt, Homo sapiens
ugauccaagcugucccaauggga

SEQ ID NO: 272 - RNA, 23 nt, Homo sapiens
gauccaagcugucccaaugggag

SEQ ID NO: 273 - RNA, 23 nt, Homo sapiens
auccaagcugucccaaugggagc

SEQ ID NO: 274 - RNA, 23 nt, Homo sapiens
uccaagcugucccaaugggagcu

SEQ ID NO: 275 - RNA, 23 nt, Homo sapiens
caagcugucccaaugggagcugc

SEQ ID NO: 276 - RNA, 23 nt, Homo sapiens
gcugucccaaugggagcugcugg

SEQ ID NO: 277 - RNA, 23 nt, Homo sapiens
ggggugcaggagaggagaacugc

SEQ ID NO: 278 - RNA, 23 nt, Homo sapiens
agaaacugaccaaaaucaucugu

SEQ ID NO: 279 - RNA, 23 nt, Homo sapiens
gaaacugaccaaaaucaucugug

SEQ ID NO: 280 - RNA, 23 nt, Homo sapiens
aaacugaccaaaaucaucugugc

SEQ ID NO: 281 - RNA, 23 nt, Homo sapiens
ugaccaaaaucaucugugcccag

SEQ ID NO: 282 - RNA, 23 nt, Homo sapiens
gaccaaaaucaucugugcccagc

SEQ ID NO: 283 - RNA, 23 nt, Homo sapiens
caaaaucaucugugcccagcagu

SEQ ID NO: 284 - RNA, 23 nt, Homo sapiens
cugugcccagcagugcuccgggc

SEQ ID NO: 285 - RNA, 23 nt, Homo sapiens
gugcccagcagugcuccgggcgc

SEQ ID NO: 286 - RNA, 23 nt, Homo sapiens
ccccagugacugcugccacaacc

SEQ ID NO: 287 - RNA, 23 nt, Homo sapiens
cccagugacugcugccacaacca

SEQ ID NO: 288 - RNA, 23 nt, Homo sapiens
gggagagcgacugccuggucugc

SEQ ID NO: 289 - RNA, 23 nt, Homo sapiens
ggagagcgacugccuggucugcc

SEQ ID NO: 290 - RNA, 23 nt, Homo sapiens
gagagcgacugccuggucugccg

SEQ ID NO: 291 - RNA, 23 nt, Homo sapiens
agagcgacugccuggucugccgc

SEQ ID NO: 292 - RNA, 23 nt, Homo sapiens
gagcgacugccuggucugccgca

SEQ ID NO: 293 - RNA, 23 nt, Homo sapiens
agcgacugccuggucugccgcaa

SEQ ID NO: 294 - RNA, 23 nt, Homo sapiens
cugccuggucugccgcaaauucc

SEQ ID NO: 295 - RNA, 23 nt, Homo sapiens
ugccuggucugccgcaaauuccg

SEQ ID NO: 296 - RNA, 23 nt, Homo sapiens
gccuggucugccgcaaauuccga

SEQ ID NO: 297 - RNA, 23 nt, Homo sapiens
ccuggucugccgcaaauuccgag

SEQ ID NO: 298 - RNA, 23 nt, Homo sapiens
uggucugccgcaaauuccgagac

SEQ ID NO: 299 - RNA, 23 nt, Homo sapiens
ggucugccgcaaauuccgagacg

SEQ ID NO: 300 - RNA, 23 nt, Homo sapiens
gucugccgcaaauuccgagacga

SEQ ID NO: 301 - RNA, 23 nt, Homo sapiens
ucugccgcaaauuccgagacgaa

SEQ ID NO: 302 - RNA, 23 nt, Homo sapiens
ugccgcaaauuccgagacgaagc

SEQ ID NO: 303 - RNA, 23 nt, Homo sapiens
caaauuccgagacgaagccacgu

SEQ ID NO: 304 - RNA, 23 nt, Homo sapiens
aaauuccgagacgaagccacgug

SEQ ID NO: 305 - RNA, 23 nt, Homo sapiens
aauuccgagacgaagccacgugc

SEQ ID NO: 306 - RNA, 23 nt, Homo sapiens
auuccgagacgaagccacgugca

SEQ ID NO: 307 - RNA, 23 nt, Homo sapiens
uuccgagacgaagccacgugcaa

SEQ ID NO: 308 - RNA, 23 nt, Homo sapiens
ccgagacgaagccacgugcaagg

SEQ ID NO: 309 - RNA, 23 nt, Homo sapiens
agacgaagccacgugcaaggaca

SEQ ID NO: 310 - RNA, 23 nt, Homo sapiens
gacgaagccacgugcaaggacac

SEQ ID NO: 311 - RNA, 23 nt, Homo sapiens
acgaagccacgugcaaggacacc

SEQ ID NO: 312 - RNA, 23 nt, Homo sapiens
cgaagccacgugcaaggacaccu

SEQ ID NO: 313 - RNA, 23 nt, Homo sapiens
ccccccacucaugcucuacaacc

SEQ ID NO: 314 - RNA, 23 nt, Homo sapiens
ccccacucaugcucuacaacccc

SEQ ID NO: 315 - RNA, 23 nt, Homo sapiens
ccacucaugcucuacaaccccac

SEQ ID NO: 316 - RNA, 23 nt, Homo sapiens
cucaugcucuacaaccccaccac

SEQ ID NO: 317 - RNA, 23 nt, Homo sapiens
uaccagauggaugugaaccccga

SEQ ID NO: 318 - RNA, 23 nt, Homo sapiens
ccagauggaugugaaccccgagg

SEQ ID NO: 319 - RNA, 23 nt, Homo sapiens
cagauggaugugaaccccgaggg

SEQ ID NO: 320 - RNA, 23 nt, Homo sapiens
agauggaugugaaccccgagggc

SEQ ID NO: 321 - RNA, 23 nt, Homo sapiens
auggaugugaaccccgagggcaa

SEQ ID NO: 322 - RNA, 23 nt, Homo sapiens
uggaugugaaccccgagggcaaa

SEQ ID NO: 323 - RNA, 23 nt, Homo sapiens
gaugugaaccccgagggcaaaua

SEQ ID NO: 324 - RNA, 23 nt, Homo sapiens
ugaaccccgagggcaaauacagc

SEQ ID NO: 325 - RNA, 23 nt, Homo sapiens
gaaccccgagggcaaauacagcu

SEQ ID NO: 326 - RNA, 23 nt, Homo sapiens
accccgagggcaaauacagcuuu

SEQ ID NO: 327 - RNA, 23 nt, Homo sapiens
ccccgagggcaaauacagcuuug

SEQ ID NO: 328 - RNA, 23 nt, Homo sapiens
cccgagggcaaauacagcuuugg

SEQ ID NO: 329 - RNA, 23 nt, Homo sapiens
gcaaauacagcuuuggugccacc

SEQ ID NO: 330 - RNA, 23 nt, Homo sapiens
caaauacagcuuuggugccaccu

SEQ ID NO: 331 - RNA, 23 nt, Homo sapiens
aaauacagcuuuggugccaccug

SEQ ID NO: 332 - RNA, 23 nt, Homo sapiens
agcuuuggugccaccugcgugaa

SEQ ID NO: 333 - RNA, 23 nt, Homo sapiens
cuuuggugccaccugcgugaaga

SEQ ID NO: 334 - RNA, 23 nt, Homo sapiens
ugccaccugcgugaagaaguguc

SEQ ID NO: 335 - RNA, 23 nt, Homo sapiens
accugcgugaagaaguguccccg

SEQ ID NO: 336 - RNA, 23 nt, Homo sapiens
ccugcgugaagaaguguccccgu

SEQ ID NO: 337 - RNA, 23 nt, Homo sapiens
cugcgugaagaaguguccccgua

SEQ ID NO: 338 - RNA, 23 nt, Homo sapiens
ugcgugaagaaguguccccguaa

SEQ ID NO: 339 - RNA, 23 nt, Homo sapiens
gcgugaagaaguguccccguaau

SEQ ID NO: 340 - RNA, 23 nt, Homo sapiens
cgugaagaaguguccccguaauu

SEQ ID NO: 341 - RNA, 23 nt, Homo sapiens
gugaagaaguguccccguaauua

SEQ ID NO: 342 - RNA, 23 nt, Homo sapiens
ugaagaaguguccccguaauuau

SEQ ID NO: 343 - RNA, 23 nt, Homo sapiens
gaagaaguguccccguaauuaug

SEQ ID NO: 344 - RNA, 23 nt, Homo sapiens
aagaaguguccccguaauuaugu

SEQ ID NO: 345 - RNA, 23 nt, Homo sapiens
agaaguguccccguaauuaugug

SEQ ID NO: 346 - RNA, 23 nt, Homo sapiens
gaaguguccccguaauuaugugg

SEQ ID NO: 347 - RNA, 23 nt, Homo sapiens
aaguguccccguaauuauguggu

SEQ ID NO: 348 - RNA, 23 nt, Homo sapiens
aguguccccguaauuauguggug

SEQ ID NO: 349 - RNA, 23 nt, Homo sapiens
guguccccguaauuaugugguga

SEQ ID NO: 350 - RNA, 23 nt, Homo sapiens
guccccguaauuauguggugaca

SEQ ID NO: 351 - RNA, 23 nt, Homo sapiens
ccccguaauuauguggugacaga

SEQ ID NO: 352 - RNA, 23 nt, Homo sapiens
ccguaauuauguggugacagauc

SEQ ID NO: 353 - RNA, 23 nt, Homo sapiens
cguaauuauguggugacagauca

SEQ ID NO: 354 - RNA, 23 nt, Homo sapiens
guaauuauguggugacagaucac

SEQ ID NO: 355 - RNA, 23 nt, Homo sapiens
uaauuauguggugacagaucacg

SEQ ID NO: 356 - RNA, 23 nt, Homo sapiens
aauuauguggugacagaucacgg

SEQ ID NO: 357 - RNA, 23 nt, Homo sapiens
uuauguggugacagaucacggcu

SEQ ID NO: 358 - RNA, 23 nt, Homo sapiens
uguggugacagaucacggcucgu

SEQ ID NO: 359 - RNA, 23 nt, Homo sapiens
uggugacagaucacggcucgugc

SEQ ID NO: 360 - RNA, 23 nt, Homo sapiens
ggugacagaucacggcucgugcg

SEQ ID NO: 361 - RNA, 23 nt, Homo sapiens
gugacagaucacggcucgugcgu

SEQ ID NO: 362 - RNA, 23 nt, Homo sapiens
ugacagaucacggcucgugcguc

SEQ ID NO: 363 - RNA, 23 nt, Homo sapiens
gacagaucacggcucgugcgucc

SEQ ID NO: 364 - RNA, 23 nt, Homo sapiens
acagaucacggcucgugcguccg

SEQ ID NO: 365 - RNA, 23 nt, Homo sapiens
cagaucacggcucgugcguccga

SEQ ID NO: 366 - RNA, 23 nt, Homo sapiens
agaucacggcucgugcguccgag

SEQ ID NO: 367 - RNA, 23 nt, Homo sapiens
gaucacggcucgugcguccgagc

SEQ ID NO: 368 - RNA, 23 nt, Homo sapiens
aucacggcucgugcguccgagcc

SEQ ID NO: 369 - RNA, 23 nt, Homo sapiens
ucacggcucgugcguccgagccu

SEQ ID NO: 370 - RNA, 23 nt, Homo sapiens
cggcucgugcguccgagccugug

SEQ ID NO: 371 - RNA, 23 nt, Homo sapiens
auggaggaagacggcguccgcaa

SEQ ID NO: 372 - RNA, 23 nt, Homo sapiens
uggaggaagacggcguccgcaag

SEQ ID NO: 373 - RNA, 23 nt, Homo sapiens
gaggaagacggcguccgcaagug

SEQ ID NO: 374 - RNA, 23 nt, Homo sapiens
aggaagacggcguccgcaagugu

SEQ ID NO: 375 - RNA, 23 nt, Homo sapiens
ggaagacggcguccgcaagugua

SEQ ID NO: 376 - RNA, 23 nt, Homo sapiens
aagacggcguccgcaaguguaag

SEQ ID NO: 377 - RNA, 23 nt, Homo sapiens
agacggcguccgcaaguguaaga

SEQ ID NO: 378 - RNA, 23 nt, Homo sapiens
cggcguccgcaaguguaagaagu

SEQ ID NO: 379 - RNA, 23 nt, Homo sapiens
ggcguccgcaaguguaagaagug

SEQ ID NO: 380 - RNA, 23 nt, Homo sapiens
gcguccgcaaguguaagaagugc

SEQ ID NO: 381 - RNA, 23 nt, Homo sapiens
cguccgcaaguguaagaagugcg

SEQ ID NO: 382 - RNA, 23 nt, Homo sapiens
guccgcaaguguaagaagugcga

SEQ ID NO: 383 - RNA, 23 nt, Homo sapiens
uccgcaaguguaagaagugcgaa

SEQ ID NO: 384 - RNA, 23 nt, Homo sapiens
ccgcaaguguaagaagugcgaag

SEQ ID NO: 385 - RNA, 23 nt, Homo sapiens
gcaaguguaagaagugcgaaggg

SEQ ID NO: 386 - RNA, 23 nt, Homo sapiens
caaguguaagaagugcgaagggc

SEQ ID NO: 387 - RNA, 23 nt, Homo sapiens
aaguguaagaagugcgaagggcc

SEQ ID NO: 388 - RNA, 23 nt, Homo sapiens
aguguaagaagugcgaagggccu

SEQ ID NO: 389 - RNA, 23 nt, Homo sapiens
guguaagaagugcgaagggccuu

SEQ ID NO: 390 - RNA, 23 nt, Homo sapiens
uguaagaagugcgaagggccuug

SEQ ID NO: 391 - RNA, 23 nt, Homo sapiens
guaagaagugcgaagggccuugc

SEQ ID NO: 392 - RNA, 23 nt, Homo sapiens
uaagaagugcgaagggccuugcc

SEQ ID NO: 393 - RNA, 23 nt, Homo sapiens
gaagugcgaagggccuugccgca

SEQ ID NO: 394 - RNA, 23 nt, Homo sapiens
aagugcgaagggccuugccgcaa

SEQ ID NO: 395 - RNA, 23 nt, Homo sapiens
agugcgaagggccuugccgcaaa

SEQ ID NO: 396 - RNA, 23 nt, Homo sapiens
gugcgaagggccuugccgcaaag

SEQ ID NO: 397 - RNA, 23 nt, Homo sapiens
ugcgaagggccuugccgcaaagu

SEQ ID NO: 398 - RNA, 23 nt, Homo sapiens
cgaagggccuugccgcaaagugu

SEQ ID NO: 399 - RNA, 23 nt, Homo sapiens
gaagggccuugccgcaaagugug

SEQ ID NO: 400 - RNA, 23 nt, Homo sapiens
aagggccuugccgcaaagugugu

SEQ ID NO: 401 - RNA, 23 nt, Homo sapiens
agggccuugccgcaaagugugua

SEQ ID NO: 402 - RNA, 23 nt, Homo sapiens
gggccuugccgcaaaguguguaa

SEQ ID NO: 403 - RNA, 23 nt, Homo sapiens
gccuugccgcaaaguguguaacg

SEQ ID NO: 404 - RNA, 23 nt, Homo sapiens
acggaauagguauuggugaauuu

SEQ ID NO: 405 - RNA, 23 nt, Homo sapiens
cggaauagguauuggugaauuua

SEQ ID NO: 406 - RNA, 23 nt, Homo sapiens
ggaauagguauuggugaauuuaa

SEQ ID NO: 407 - RNA, 23 nt, Homo sapiens
gaauagguauuggugaauuuaaa

SEQ ID NO: 408 - RNA, 23 nt, Homo sapiens
auagguauuggugaauuuaaaga

SEQ ID NO: 409 - RNA, 23 nt, Homo sapiens
uagguauuggugaauuuaaagac

SEQ ID NO: 410 - RNA, 23 nt, Homo sapiens
cucacucuccauaaaugcuacga

SEQ ID NO: 411 - RNA, 23 nt, Homo sapiens
uauuaaacacuucaaaaacugca

SEQ ID NO: 412 - RNA, 23 nt, Homo sapiens
cacuucaaaaacugcaccuccau

SEQ ID NO: 413 - RNA, 23 nt, Homo sapiens
acuucaaaaacugcaccuccauc

SEQ ID NO: 414 - RNA, 23 nt, Homo sapiens
cuucaaaaacugcaccuccauca

SEQ ID NO: 415 - RNA, 23 nt, Homo sapiens
uucaaaaacugcaccuccaucag

SEQ ID NO: 416 - RNA, 23 nt, Homo sapiens
ucaaaaacugcaccuccaucagu

SEQ ID NO: 417 - RNA, 23 nt, Homo sapiens
aaacugcaccuccaucaguggcg

SEQ ID NO: 418 - RNA, 23 nt, Homo sapiens
ugcaccuccaucaguggcgaucu

SEQ ID NO: 419 - RNA, 23 nt, Homo sapiens
gcaccuccaucaguggcgaucuc

SEQ ID NO: 420 - RNA, 23 nt, Homo sapiens
accuccaucaguggcgaucucca

SEQ ID NO: 421 - RNA, 23 nt, Homo sapiens
uccaucaguggcgaucuccacau

SEQ ID NO: 422 - RNA, 23 nt, Homo sapiens
aguggcgaucuccacauccugcc

SEQ ID NO: 423 - RNA, 23 nt, Homo sapiens
guggcgaucuccacauccugccg

SEQ ID NO: 424 - RNA, 23 nt, Homo sapiens
uggcgaucuccacauccugccgg

SEQ ID NO: 425 - RNA, 23 nt, Homo sapiens
ggcgaucuccacauccugccggu

SEQ ID NO: 426 - RNA, 23 nt, Homo sapiens
gcgaucuccacauccugccggug

SEQ ID NO: 427 - RNA, 23 nt, Homo sapiens
cuccacauccugccgguggcauu

SEQ ID NO: 428 - RNA, 23 nt, Homo sapiens
uccacauccugccgguggcauuu

SEQ ID NO: 429 - RNA, 23 nt, Homo sapiens
ccacauccugccgguggcauuua

SEQ ID NO: 430 - RNA, 23 nt, Homo sapiens
acauccugccgguggcauuuagg

SEQ ID NO: 431 - RNA, 23 nt, Homo sapiens
uccugccgguggcauuuaggggu

SEQ ID NO: 432 - RNA, 23 nt, Homo sapiens
ccugccgguggcauuuaggggug

SEQ ID NO: 433 - RNA, 23 nt, Homo sapiens
cugccgguggcauuuagggguga

SEQ ID NO: 434 - RNA, 23 nt, Homo sapiens
ugccgguggcauuuaggggugac

SEQ ID NO: 435 - RNA, 23 nt, Homo sapiens
cgguggcauuuaggggugacucc

SEQ ID NO: 436 - RNA, 23 nt, Homo sapiens
uggcauuuaggggugacuccuuc

SEQ ID NO: 437 - RNA, 23 nt, Homo sapiens
ggcauuuaggggugacuccuuca

SEQ ID NO: 438 - RNA, 23 nt, Homo sapiens
gcauuuaggggugacuccuucac

SEQ ID NO: 439 - RNA, 23 nt, Homo sapiens
cauuuaggggugacuccuucaca

SEQ ID NO: 440 - RNA, 23 nt, Homo sapiens
auuuaggggugacuccuucacac

SEQ ID NO: 441 - RNA, 23 nt, Homo sapiens
uuuaggggugacuccuucacaca

SEQ ID NO: 442 - RNA, 23 nt, Homo sapiens
ccucuggauccacaggaacugga

SEQ ID NO: 443 - RNA, 23 nt, Homo sapiens
uggauccacaggaacuggauauu

SEQ ID NO: 444 - RNA, 23 nt, Homo sapiens
ggauccacaggaacuggauauuc

SEQ ID NO: 445 - RNA, 23 nt, Homo sapiens
auccacaggaacuggauauucug

SEQ ID NO: 446 - RNA, 23 nt, Homo sapiens
uccacaggaacuggauauucuga

SEQ ID NO: 447 - RNA, 23 nt, Homo sapiens
gaacuggauauucugaaaaccgu

SEQ ID NO: 448 - RNA, 23 nt, Homo sapiens
auauucugaaaaccguaaaggaa

SEQ ID NO: 449 - RNA, 23 nt, Homo sapiens
uauucugaaaaccguaaaggaaa

SEQ ID NO: 450 - RNA, 23 nt, Homo sapiens
ucugaaaaccguaaaggaaauca

SEQ ID NO: 451 - RNA, 23 nt, Homo sapiens
cugaaaaccguaaaggaaaucac

SEQ ID NO: 452 - DNA, 21 bp, Artificial Sequence
  Description of Artificial Sequence: Synthetic oligonucleotide
  Description of Combined DNA/RNA Molecule: Synthetic oligonucleotide
cggccggagucccgagcuatt

SEQ ID NO: 453 - DNA, 21 bp, Artificial Sequence
  Description of Artificial Sequence: Synthetic oligonucleotide
  Description of Combined DNA/RNA Molecule: Synthetic oligonucleotide
uagcucgggacuccggccgtt

SEQ ID NO: 454 - DNA, 21 bp, Artificial Sequence
  Description of Artificial Sequence: Synthetic oligonucleotide
  Description of Combined DNA/RNA Molecule: Synthetic oligonucleotide
ccggagucccgagcuagcctt

SEQ ID NO: 455 - DNA, 21 bp, Artificial Sequence
  Description of Artificial Sequence: Synthetic oligonucleotide
  Description of Combined DNA/RNA Molecule: Synthetic oligonucleotide
ggcuagcucgggacuccggtt

SEQ ID NO: 456 - DNA, 21 bp, Artificial Sequence
  Description of Artificial Sequence: Synthetic oligonucleotide
  Description of Combined DNA/RNA Molecule: Synthetic oligonucleotide
cggagucccgagcuagccctt

SEQ ID NO: 457 - DNA, 21 bp, Artificial Sequence
  Description of Artificial Sequence: Synthetic oligonucleotide
  Description of Combined DNA/RNA Molecule: Synthetic oligonucleotide
gggcuagcucgggacuccgtt

SEQ ID NO: 458 - DNA, 21 bp, Artificial Sequence
  Description of Artificial Sequence: Synthetic oligonucleotide
  Description of Combined DNA/RNA Molecule: Synthetic oligonucleotide
ggagucccgagcuagcccctt

SEQ ID NO: 459 - DNA, 21 bp, Artificial Sequence
  Description of Artificial Sequence: Synthetic oligonucleotide
  Description of Combined DNA/RNA Molecule: Synthetic oligonucleotide
ggggcuagcucgggacucctt

SEQ ID NO: 460 - DNA, 21 bp, Artificial Sequence
  Description of Artificial Sequence: Synthetic oligonucleotide
  Description of Combined DNA/RNA Molecule: Synthetic oligonucleotide
gagucccgagcuagccccgtt

SEQ ID NO: 461 - DNA, 21 bp, Artificial Sequence
  Description of Artificial Sequence: Synthetic oligonucleotide
  Description of Combined DNA/RNA Molecule: Synthetic oligonucleotide
cggggcuagcucgggacuctt

SEQ ID NO: 462 - DNA, 21 bp, Artificial Sequence
  Description of Artificial Sequence: Synthetic oligonucleotide
  Description of Combined DNA/RNA Molecule: Synthetic oligonucleotide
agucccgagcuagccccggtt

SEQ ID NO: 463 - DNA, 21 bp, Artificial Sequence
  Description of Artificial Sequence: Synthetic oligonucleotide
  Description of Combined DNA/RNA Molecule: Synthetic oligonucleotide
ccggggcuagcucgggacutt

SEQ ID NO: 464 - DNA, 21 bp, Artificial Sequence
  Description of Artificial Sequence: Synthetic oligonucleotide
  Description of Combined DNA/RNA Molecule: Synthetic oligonucleotide
gucccgagcuagccccggctt

SEQ ID NO: 465 - DNA, 21 bp, Artificial Sequence
  Description of Artificial Sequence: Synthetic oligonucleotide
  Description of Combined DNA/RNA Molecule: Synthetic oligonucleotide
gccggggcuagcucgggactt

SEQ ID NO: 466 - DNA, 21 bp, Artificial Sequence
  Description of Artificial Sequence: Synthetic oligonucleotide
  Description of Combined DNA/RNA Molecule: Synthetic oligonucleotide
cccgagcuagccccggcggtt

SEQ ID NO: 467 - DNA, 21 bp, Artificial Sequence
  Description of Artificial Sequence: Synthetic oligonucleotide
  Description of Combined DNA/RNA Molecule: Synthetic oligonucleotide
ccgccggggcuagcucgggtt

SEQ ID NO: 468 - DNA, 21 bp, Artificial Sequence
  Description of Artificial Sequence: Synthetic oligonucleotide
  Description of Combined DNA/RNA Molecule: Synthetic oligonucleotide
ggacgacaggccaccucgutt

SEQ ID NO: 469 - DNA, 21 bp, Artificial Sequence
  Description of Artificial Sequence: Synthetic oligonucleotide
  Description of Combined DNA/RNA Molecule: Synthetic oligonucleotide
acgagguggccugucgucctt

SEQ ID NO: 470 - DNA, 21 bp, Artificial Sequence
  Description of Artificial Sequence: Synthetic oligonucleotide
  Description of Combined DNA/RNA Molecule: Synthetic oligonucleotide
gacgacaggccaccucguctt

SEQ ID NO: 471 - DNA, 21 bp, Artificial Sequence
  Description of Artificial Sequence: Synthetic oligonucleotide
  Description of Combined DNA/RNA Molecule: Synthetic oligonucleotide
gacgagguggccugucguctt

SEQ ID NO: 472 - DNA, 21 bp, Artificial Sequence
  Description of Artificial Sequence: Synthetic oligonucleotide
  Description of Combined DNA/RNA Molecule: Synthetic oligonucleotide
acgacaggccaccucgucgtt

SEQ ID NO: 473 - DNA, 21 bp, Artificial Sequence
  Description of Artificial Sequence: Synthetic oligonucleotide
  Description of Combined DNA/RNA Molecule: Synthetic oligonucleotide
cgacgagguggccugucgutt

SEQ ID NO: 474 - DNA, 21 bp, Artificial Sequence
  Description of Artificial Sequence: Synthetic oligonucleotide
  Description of Combined DNA/RNA Molecule: Synthetic oligonucleotide
cgacaggccaccucgucggtt

SEQ ID NO: 475 - DNA, 21 bp, Artificial Sequence
  Description of Artificial Sequence: Synthetic oligonucleotide
  Description of Combined DNA/RNA Molecule: Synthetic oligonucleotide
ccgacgagguggccugucgtt

SEQ ID NO: 476 - DNA, 21 bp, Artificial Sequence
  Description of Artificial Sequence: Synthetic oligonucleotide
  Description of Combined DNA/RNA Molecule: Synthetic oligonucleotide
gacaggccaccucgucggctt

SEQ ID NO: 477 - DNA, 21 bp, Artificial Sequence
  Description of Artificial Sequence: Synthetic oligonucleotide
  Description of Combined DNA/RNA Molecule: Synthetic oligonucleotide
gccgacgagguggccuguctt

SEQ ID NO: 478 - DNA, 21 bp, Artificial Sequence
  Description of Artificial Sequence: Synthetic oligonucleotide
  Description of Combined DNA/RNA Molecule: Synthetic oligonucleotide
caggccaccucgucggcgutt

SEQ ID NO: 479 - DNA, 21 bp, Artificial Sequence
  Description of Artificial Sequence: Synthetic oligonucleotide
  Description of Combined DNA/RNA Molecule: Synthetic oligonucleotide
acgccgacgagguggccugtt

SEQ ID NO: 480 - DNA, 21 bp, Artificial Sequence
  Description of Artificial Sequence: Synthetic oligonucleotide
  Description of Combined DNA/RNA Molecule: Synthetic oligonucleotide
aggccaccucgucggcguctt

SEQ ID NO: 481 - DNA, 21 bp, Artificial Sequence
  Description of Artificial Sequence: Synthetic oligonucleotide
  Description of Combined DNA/RNA Molecule: Synthetic oligonucleotide
gacgccgacgagguggccutt

SEQ ID NO: 482 - DNA, 21 bp, Artificial Sequence
  Description of Artificial Sequence: Synthetic oligonucleotide
  Description of Combined DNA/RNA Molecule: Synthetic oligonucleotide
ggccaccucgucggcgucctt

SEQ ID NO: 483 - DNA, 21 bp, Artificial Sequence
  Description of Artificial Sequence: Synthetic oligonucleotide
  Description of Combined DNA/RNA Molecule: Synthetic oligonucleotide
ggacgccgacgagguggcctt

SEQ ID NO: 484 - DNA, 21 bp, Artificial Sequence
  Description of Artificial Sequence: Synthetic oligonucleotide
  Description of Combined DNA/RNA Molecule: Synthetic oligonucleotide
gccaccucgucggcguccgtt

SEQ ID NO: 485 - DNA, 21 bp, Artificial Sequence
  Description of Artificial Sequence: Synthetic oligonucleotide
  Description of Combined DNA/RNA Molecule: Synthetic oligonucleotide
cggacgccgacgagguggctt

SEQ ID NO: 486 - DNA, 21 bp, Artificial Sequence
  Description of Artificial Sequence: Synthetic oligonucleotide
  Description of Combined DNA/RNA Molecule: Synthetic oligonucleotide
ccaccucgucggcguccgctt

SEQ ID NO: 487 - DNA, 21 bp, Artificial Sequence
  Description of Artificial Sequence: Synthetic oligonucleotide
  Description of Combined DNA/RNA Molecule: Synthetic oligonucleotide
gcggacgccgacgagguggtt

SEQ ID NO: 488 - DNA, 21 bp, Artificial Sequence
  Description of Artificial Sequence: Synthetic oligonucleotide
  Description of Combined DNA/RNA Molecule: Synthetic oligonucleotide
caccucgucggcguccgcctt

SEQ ID NO: 489 - DNA, 21 bp, Artificial Sequence
  Description of Artificial Sequence: Synthetic oligonucleotide
  Description of Combined DNA/RNA Molecule: Synthetic oligonucleotide
ggcggacgccgacgaggugtt

SEQ ID NO: 490 - DNA, 21 bp, Artificial Sequence
  Description of Artificial Sequence: Synthetic oligonucleotide
  Description of Combined DNA/RNA Molecule: Synthetic oligonucleotide
accucgucggcguccgccctt

SEQ ID NO: 491 - DNA, 21 bp, Artificial Sequence
  Description of Artificial Sequence: Synthetic oligonucleotide
  Description of Combined DNA/RNA Molecule: Synthetic oligonucleotide
gggcggacgccgacgaggutt

SEQ ID NO: 492 - DNA, 21 bp, Artificial Sequence
  Description of Artificial Sequence: Synthetic oligonucleotide
  Description of Combined DNA/RNA Molecule: Synthetic oligonucleotide
ccucgucggcguccgcccgtt

SEQ ID NO: 493 - DNA, 21 bp, Artificial Sequence
  Description of Artificial Sequence: Synthetic oligonucleotide
  Description of Combined DNA/RNA Molecule: Synthetic oligonucleotide
cgggcggacgccgacgaggtt

SEQ ID NO: 494 - DNA, 21 bp, Artificial Sequence
  Description of Artificial Sequence: Synthetic oligonucleotide
  Description of Combined DNA/RNA Molecule: Synthetic oligonucleotide
cucgucggcguccgcccgatt

SEQ ID NO: 495 - DNA, 21 bp, Artificial Sequence
  Description of Artificial Sequence: Synthetic oligonucleotide
  Description of Combined DNA/RNA Molecule: Synthetic oligonucleotide
ucgggcggacgccgacgagtt

SEQ ID NO: 496 - DNA, 21 bp, Artificial Sequence
  Description of Artificial Sequence: Synthetic oligonucleotide
  Description of Combined DNA/RNA Molecule: Synthetic oligonucleotide
ucgucggcguccgcccgagtt

SEQ ID NO: 497 - DNA, 21 bp, Artificial Sequence
  Description of Artificial Sequence: Synthetic oligonucleotide
  Description of Combined DNA/RNA Molecule: Synthetic oligonucleotide
cucgggcggacgccgacgatt

SEQ ID NO: 498 - DNA, 21 bp, Artificial Sequence
  Description of Artificial Sequence: Synthetic oligonucleotide
  Description of Combined DNA/RNA Molecule: Synthetic oligonucleotide
cgucggcguccgcccgagutt

SEQ ID NO: 499 - DNA, 21 bp, Artificial Sequence
  Description of Artificial Sequence: Synthetic oligonucleotide
  Description of Combined DNA/RNA Molecule: Synthetic oligonucleotide
acucgggcggacgccgacgtt

SEQ ID NO: 500 - DNA, 21 bp, Artificial Sequence
  Description of Artificial Sequence: Synthetic oligonucleotide
  Description of Combined DNA/RNA Molecule: Synthetic oligonucleotide
gucggcguccgcccgaguctt

SEQ ID NO: 501 - DNA, 21 bp, Artificial Sequence
  Description of Artificial Sequence: Synthetic oligonucleotide
  Description of Combined DNA/RNA Molecule: Synthetic oligonucleotide
gacucgggcggacgccgactt

SEQ ID NO: 502 - DNA, 21 bp, Artificial Sequence
  Description of Artificial Sequence: Synthetic oligonucleotide
  Description of Combined DNA/RNA Molecule: Synthetic oligonucleotide
ucggcguccgcccgagucctt

SEQ ID NO: 503 - DNA, 21 bp, Artificial Sequence
  Description of Artificial Sequence: Synthetic oligonucleotide
  Description of Combined DNA/RNA Molecule: Synthetic oligonucleotide
ggacucgggcggacgccgatt

SEQ ID NO: 504 - DNA, 21 bp, Artificial Sequence
  Description of Artificial Sequence: Synthetic oligonucleotide
  Description of Combined DNA/RNA Molecule: Synthetic oligonucleotide
gcguccgcccgaguccccgtt

SEQ ID NO: 505 - DNA, 21 bp, Artificial Sequence
  Description of Artificial Sequence: Synthetic oligonucleotide
  Description of Combined DNA/RNA Molecule: Synthetic oligonucleotide
cggggacucgggcggacgctt

SEQ ID NO: 506 - DNA, 21 bp, Artificial Sequence
  Description of Artificial Sequence: Synthetic oligonucleotide
  Description of Combined DNA/RNA Molecule: Synthetic oligonucleotide
cguccgcccgaguccccgctt

SEQ ID NO: 507 - DNA, 21 bp, Artificial Sequence
  Description of Artificial Sequence: Synthetic oligonucleotide
  Description of Combined DNA/RNA Molecule: Synthetic oligonucleotide
gcggggacucgggcggacgtt

SEQ ID NO: 508 - DNA, 21 bp, Artificial Sequence
  Description of Artificial Sequence: Synthetic oligonucleotide
  Description of Combined DNA/RNA Molecule: Synthetic oligonucleotide
gcccgaguccccgccucgctt

SEQ ID NO: 509 - DNA, 21 bp, Artificial Sequence
  Description of Artificial Sequence: Synthetic oligonucleotide
  Description of Combined DNA/RNA Molecule: Synthetic oligonucleotide
gcgaggcggggacucgggctt

SEQ ID NO: 510 - DNA, 21 bp, Artificial Sequence
  Description of Artificial Sequence: Synthetic oligonucleotide
  Description of Combined DNA/RNA Molecule: Synthetic oligonucleotide
aacgccacaaccaccgcgctt

SEQ ID NO: 511 - DNA, 21 bp, Artificial Sequence
  Description of Artificial Sequence: Synthetic oligonucleotide
  Description of Combined DNA/RNA Molecule: Synthetic oligonucleotide
gcgcggugguuguggcguutt

SEQ ID NO: 512 - DNA, 21 bp, Artificial Sequence
  Description of Artificial Sequence: Synthetic oligonucleotide
  Description of Combined DNA/RNA Molecule: Synthetic oligonucleotide
acgccacaaccaccgcgcatt

SEQ ID NO: 513 - DNA, 21 bp, Artificial Sequence
  Description of Artificial Sequence: Synthetic oligonucleotide
  Description of Combined DNA/RNA Molecule: Synthetic oligonucleotide
ugcgcggugguuguggcgutt

SEQ ID NO: 514 - DNA, 21 bp, Artificial Sequence
  Description of Artificial Sequence: Synthetic oligonucleotide
  Description of Combined DNA/RNA Molecule: Synthetic oligonucleotide
cgccacaaccaccgcgcactt

SEQ ID NO: 515 - DNA, 21 bp, Artificial Sequence
  Description of Artificial Sequence: Synthetic oligonucleotide
  Description of Combined DNA/RNA Molecule: Synthetic oligonucleotide
gugcgcggugguuguggcgtt

SEQ ID NO: 516 - DNA, 21 bp, Artificial Sequence
  Description of Artificial Sequence: Synthetic oligonucleotide
  Description of Combined DNA/RNA Molecule: Synthetic oligonucleotide
ccacaaccaccgcgcacggtt

SEQ ID NO: 517 - DNA, 21 bp, Artificial Sequence
  Description of Artificial Sequence: Synthetic oligonucleotide
  Description of Combined DNA/RNA Molecule: Synthetic oligonucleotide
ccgugcgcggugguuguggtt

SEQ ID NO: 518 - DNA, 21 bp, Artificial Sequence
  Description of Artificial Sequence: Synthetic oligonucleotide
  Description of Combined DNA/RNA Molecule: Synthetic oligonucleotide
cacaaccaccgcgcacggctt

SEQ ID NO: 519 - DNA, 21 bp, Artificial Sequence
  Description of Artificial Sequence: Synthetic oligonucleotide
  Description of Combined DNA/RNA Molecule: Synthetic oligonucleotide
gccgugcgcggugguugugtt

SEQ ID NO: 520 - DNA, 21 bp, Artificial Sequence
  Description of Artificial Sequence: Synthetic oligonucleotide
  Description of Combined DNA/RNA Molecule: Synthetic oligonucleotide
acaaccaccgcgcacggcctt

SEQ ID NO: 521 - DNA, 21 bp, Artificial Sequence
  Description of Artificial Sequence: Synthetic oligonucleotide
  Description of Combined DNA/RNA Molecule: Synthetic oligonucleotide
ggccgugcgcggugguugutt

SEQ ID NO: 522 - DNA, 21 bp, Artificial Sequence
  Description of Artificial Sequence: Synthetic oligonucleotide
  Description of Combined DNA/RNA Molecule: Synthetic oligonucleotide
augcgacccuccgggacggtt

SEQ ID NO: 523 - DNA, 21 bp, Artificial Sequence
  Description of Artificial Sequence: Synthetic oligonucleotide
  Description of Combined DNA/RNA Molecule: Synthetic oligonucleotide
ccgucccggagggucgcautt

SEQ ID NO: 524 - DNA, 21 bp, Artificial Sequence
  Description of Artificial Sequence: Synthetic oligonucleotide
  Description of Combined DNA/RNA Molecule: Synthetic oligonucleotide
ugcgacccuccgggacggctt

SEQ ID NO: 525 - DNA, 21 bp, Artificial Sequence
  Description of Artificial Sequence: Synthetic oligonucleotide
  Description of Combined DNA/RNA Molecule: Synthetic oligonucleotide
gccgucccggagggucgcatt

SEQ ID NO: 526 - DNA, 21 bp, Artificial Sequence
  Description of Artificial Sequence: Synthetic oligonucleotide
  Description of Combined DNA/RNA Molecule: Synthetic oligonucleotide
gcgacccuccgggacggcctt

SEQ ID NO: 527 - DNA, 21 bp, Artificial Sequence
  Description of Artificial Sequence: Synthetic oligonucleotide
  Description of Combined DNA/RNA Molecule: Synthetic oligonucleotide
ggccgucccggagggucgctt

SEQ ID NO: 528 - DNA, 21 bp, Artificial Sequence
  Description of Artificial Sequence: Synthetic oligonucleotide
  Description of Combined DNA/RNA Molecule: Synthetic oligonucleotide
gacccuccgggacggccggtt

SEQ ID NO: 529 - DNA, 21 bp, Artificial Sequence
  Description of Artificial Sequence: Synthetic oligonucleotide
  Description of Combined DNA/RNA Molecule: Synthetic oligonucleotide
ccggccgucccggaggguctt

SEQ ID NO: 530 - DNA, 21 bp, Artificial Sequence
  Description of Artificial Sequence: Synthetic oligonucleotide
  Description of Combined DNA/RNA Molecule: Synthetic oligonucleotide
acccuccgggacggccgggtt

SEQ ID NO: 531 - DNA, 21 bp, Artificial Sequence
  Description of Artificial Sequence: Synthetic oligonucleotide
  Description of Combined DNA/RNA Molecule: Synthetic oligonucleotide
cccggccgucccggagggutt

SEQ ID NO: 532 - DNA, 21 bp, Artificial Sequence
  Description of Artificial Sequence: Synthetic oligonucleotide
  Description of Combined DNA/RNA Molecule: Synthetic oligonucleotide
ccuccgggacggccggggctt

SEQ ID NO: 533 - DNA, 21 bp, Artificial Sequence
  Description of Artificial Sequence: Synthetic oligonucleotide
  Description of Combined DNA/RNA Molecule: Synthetic oligonucleotide
gccccggccgucccggaggtt

SEQ ID NO: 534 - DNA, 21 bp, Artificial Sequence
  Description of Artificial Sequence: Synthetic oligonucleotide
  Description of Combined DNA/RNA Molecule: Synthetic oligonucleotide
agaaaguuugccaaggcactt

SEQ ID NO: 535 - DNA, 21 bp, Artificial Sequence
  Description of Artificial Sequence: Synthetic oligonucleotide
  Description of Combined DNA/RNA Molecule: Synthetic oligonucleotide
gugccuuggcaaacuuucutt

SEQ ID NO: 536 - DNA, 21 bp, Artificial Sequence
  Description of Artificial Sequence: Synthetic oligonucleotide
  Description of Combined DNA/RNA Molecule: Synthetic oligonucleotide
gaaaguuugccaaggcacgtt

SEQ ID NO: 537 - DNA, 21 bp, Artificial Sequence
  Description of Artificial Sequence: Synthetic oligonucleotide
  Description of Combined DNA/RNA Molecule: Synthetic oligonucleotide
cgugccuuggcaaacuuuctt

SEQ ID NO: 538 - DNA, 21 bp, Artificial Sequence
  Description of Artificial Sequence: Synthetic oligonucleotide
  Description of Combined DNA/RNA Molecule: Synthetic oligonucleotide
aaguuugccaaggcacgagtt

SEQ ID NO: 539 - DNA, 21 bp, Artificial Sequence
  Description of Artificial Sequence: Synthetic oligonucleotide
  Description of Combined DNA/RNA Molecule: Synthetic oligonucleotide
cucgugccuuggcaaacuutt

SEQ ID NO: 540 - DNA, 21 bp, Artificial Sequence
  Description of Artificial Sequence: Synthetic oligonucleotide
  Description of Combined DNA/RNA Molecule: Synthetic oligonucleotide
aguuugccaaggcacgagutt

SEQ ID NO: 541 - DNA, 21 bp, Artificial Sequence
  Description of Artificial Sequence: Synthetic oligonucleotide
  Description of Combined DNA/RNA Molecule: Synthetic oligonucleotide
acucgugccuuggcaaacutt

SEQ ID NO: 542 - DNA, 21 bp, Artificial Sequence
  Description of Artificial Sequence: Synthetic oligonucleotide
  Description of Combined DNA/RNA Molecule: Synthetic oligonucleotide
guuugccaaggcacgaguatt

SEQ ID NO: 543 - DNA, 21 bp, Artificial Sequence
  Description of Artificial Sequence: Synthetic oligonucleotide
  Description of Combined DNA/RNA Molecule: Synthetic oligonucleotide
uacucgugccuuggcaaactt

SEQ ID NO: 544 - DNA, 21 bp, Artificial Sequence
  Description of Artificial Sequence: Synthetic oligonucleotide
  Description of Combined DNA/RNA Molecule: Synthetic oligonucleotide
uuugccaaggcacgaguaatt

SEQ ID NO: 545 - DNA, 21 bp, Artificial Sequence
  Description of Artificial Sequence: Synthetic oligonucleotide
  Description of Combined DNA/RNA Molecule: Synthetic oligonucleotide
uuacucgugccuuggcaaatt

SEQ ID NO: 546 - DNA, 21 bp, Artificial Sequence
  Description of Artificial Sequence: Synthetic oligonucleotide
  Description of Combined DNA/RNA Molecule: Synthetic oligonucleotide
uugccaaggcacgaguaactt

SEQ ID NO: 547 - DNA, 21 bp, Artificial Sequence
  Description of Artificial Sequence: Synthetic oligonucleotide
  Description of Combined DNA/RNA Molecule: Synthetic oligonucleotide
guuacucgugccuuggcaatt

SEQ ID NO: 548 - DNA, 21 bp, Artificial Sequence
  Description of Artificial Sequence: Synthetic oligonucleotide
  Description of Combined DNA/RNA Molecule: Synthetic oligonucleotide
ugccaaggcacgaguaacatt

SEQ ID NO: 549 - DNA, 21 bp, Artificial Sequence
  Description of Artificial Sequence: Synthetic oligonucleotide
  Description of Combined DNA/RNA Molecule: Synthetic oligonucleotide
uguuacucgugccuuggcatt

SEQ ID NO: 550 - DNA, 21 bp, Artificial Sequence
  Description of Artificial Sequence: Synthetic oligonucleotide
  Description of Combined DNA/RNA Molecule: Synthetic oligonucleotide
gccaaggcacgaguaacaatt

SEQ ID NO: 551 - DNA, 21 bp, Artificial Sequence
  Description of Artificial Sequence: Synthetic oligonucleotide
  Description of Combined DNA/RNA Molecule: Synthetic oligonucleotide
uuguuacucgugccuuggctt

SEQ ID NO: 552 - DNA, 21 bp, Artificial Sequence
  Description of Artificial Sequence: Synthetic oligonucleotide
  Description of Combined DNA/RNA Molecule: Synthetic oligonucleotide
acgcaguugggcacuuuugtt

SEQ ID NO: 553 - DNA, 21 bp, Artificial Sequence
  Description of Artificial Sequence: Synthetic oligonucleotide
  Description of Combined DNA/RNA Molecule: Synthetic oligonucleotide
caaaagugcccaacugcgutt

SEQ ID NO: 554 - DNA, 21 bp, Artificial Sequence
  Description of Artificial Sequence: Synthetic oligonucleotide
  Description of Combined DNA/RNA Molecule: Synthetic oligonucleotide
cgcaguugggcacuuuugatt

SEQ ID NO: 555 - DNA, 21 bp, Artificial Sequence
  Description of Artificial Sequence: Synthetic oligonucleotide
  Description of Combined DNA/RNA Molecule: Synthetic oligonucleotide
ucaaaagugcccaacugcgtt

SEQ ID NO: 556 - DNA, 21 bp, Artificial Sequence
  Description of Artificial Sequence: Synthetic oligonucleotide
  Description of Combined DNA/RNA Molecule: Synthetic oligonucleotide
gcaguugggcacuuuugaatt

SEQ ID NO: 557 - DNA, 21 bp, Artificial Sequence
  Description of Artificial Sequence: Synthetic oligonucleotide
  Description of Combined DNA/RNA Molecule: Synthetic oligonucleotide
uucaaaagugcccaacugctt

SEQ ID NO: 558 - DNA, 21 bp, Artificial Sequence
  Description of Artificial Sequence: Synthetic oligonucleotide
  Description of Combined DNA/RNA Molecule: Synthetic oligonucleotide
caguugggcacuuuugaagtt

SEQ ID NO: 559 - DNA, 21 bp, Artificial Sequence
  Description of Artificial Sequence: Synthetic oligonucleotide
  Description of Combined DNA/RNA Molecule: Synthetic oligonucleotide
cuucaaaagugcccaacugtt

SEQ ID NO: 560 - DNA, 21 bp, Artificial Sequence
  Description of Artificial Sequence: Synthetic oligonucleotide
  Description of Combined DNA/RNA Molecule: Synthetic oligonucleotide
aguugggcacuuuugaagatt

SEQ ID NO: 561 - DNA, 21 bp, Artificial Sequence
  Description of Artificial Sequence: Synthetic oligonucleotide
  Description of Combined DNA/RNA Molecule: Synthetic oligonucleotide
ucuucaaaagugcccaacutt

SEQ ID NO: 562 - DNA, 21 bp, Artificial Sequence
  Description of Artificial Sequence: Synthetic oligonucleotide
  Description of Combined DNA/RNA Molecule: Synthetic oligonucleotide
guugggcacuuuugaagautt

SEQ ID NO: 563 - DNA, 21 bp, Artificial Sequence
  Description of Artificial Sequence: Synthetic oligonucleotide
  Description of Combined DNA/RNA Molecule: Synthetic oligonucleotide
aucuucaaaagugcccaactt

SEQ ID NO: 564 - DNA, 21 bp, Artificial Sequence
  Description of Artificial Sequence: Synthetic oligonucleotide
  Description of Combined DNA/RNA Molecule: Synthetic oligonucleotide
uugggcacuuuugaagauctt

SEQ ID NO: 565 - DNA, 21 bp, Artificial Sequence
  Description of Artificial Sequence: Synthetic oligonucleotide
  Description of Combined DNA/RNA Molecule: Synthetic oligonucleotide
gaucuucaaaagugcccaatt

SEQ ID NO: 566 - DNA, 21 bp, Artificial Sequence
  Description of Artificial Sequence: Synthetic oligonucleotide
  Description of Combined DNA/RNA Molecule: Synthetic oligonucleotide
ugggcacuuuugaagaucatt

SEQ ID NO: 567 - DNA, 21 bp, Artificial Sequence
  Description of Artificial Sequence: Synthetic oligonucleotide
  Description of Combined DNA/RNA Molecule: Synthetic oligonucleotide
ugaucuucaaaagugcccatt

SEQ ID NO: 568 - DNA, 21 bp, Artificial Sequence
  Description of Artificial Sequence: Synthetic oligonucleotide
  Description of Combined DNA/RNA Molecule: Synthetic oligonucleotide
gggcacuuuugaagaucautt

SEQ ID NO: 569 - DNA, 21 bp, Artificial Sequence
  Description of Artificial Sequence: Synthetic oligonucleotide
  Description of Combined DNA/RNA Molecule: Synthetic oligonucleotide
augaucuucaaaagugccctt

SEQ ID NO: 570 - DNA, 21 bp, Artificial Sequence
  Description of Artificial Sequence: Synthetic oligonucleotide
  Description of Combined DNA/RNA Molecule: Synthetic oligonucleotide
uugaagaucauuuucucagtt

SEQ ID NO: 571 - DNA, 21 bp, Artificial Sequence
  Description of Artificial Sequence: Synthetic oligonucleotide
  Description of Combined DNA/RNA Molecule: Synthetic oligonucleotide
cugagaaaaugaucuucaatt

SEQ ID NO: 572 - DNA, 21 bp, Artificial Sequence
  Description of Artificial Sequence: Synthetic oligonucleotide
  Description of Combined DNA/RNA Molecule: Synthetic oligonucleotide
gaagaucauuuucucagcctt

SEQ ID NO: 573 - DNA, 21 bp, Artificial Sequence
  Description of Artificial Sequence: Synthetic oligonucleotide
  Description of Combined DNA/RNA Molecule: Synthetic oligonucleotide
ggcugagaaaaugaucuuctt

SEQ ID NO: 574 - DNA, 21 bp, Artificial Sequence
  Description of Artificial Sequence: Synthetic oligonucleotide
  Description of Combined DNA/RNA Molecule: Synthetic oligonucleotide
aagaucauuuucucagccutt

SEQ ID NO: 575 - DNA, 21 bp, Artificial Sequence
  Description of Artificial Sequence: Synthetic oligonucleotide
  Description of Combined DNA/RNA Molecule: Synthetic oligonucleotide
aggcugagaaaaugaucuutt

SEQ ID NO: 576 - DNA, 21 bp, Artificial Sequence
  Description of Artificial Sequence: Synthetic oligonucleotide
  Description of Combined DNA/RNA Molecule: Synthetic oligonucleotide
cauuuucucagccuccagatt

SEQ ID NO: 577 - DNA, 21 bp, Artificial Sequence
  Description of Artificial Sequence: Synthetic oligonucleotide
  Description of Combined DNA/RNA Molecule: Synthetic oligonucleotide
ucuggaggcugagaaaaugtt

SEQ ID NO: 578 - DNA, 21 bp, Artificial Sequence
  Description of Artificial Sequence: Synthetic oligonucleotide
  Description of Combined DNA/RNA Molecule: Synthetic oligonucleotide
agccuccagaggauguucatt

SEQ ID NO: 579 - DNA, 21 bp, Artificial Sequence
  Description of Artificial Sequence: Synthetic oligonucleotide
  Description of Combined DNA/RNA Molecule: Synthetic oligonucleotide
ugaacauccucuggaggcutt

SEQ ID NO: 580 - DNA, 21 bp, Artificial Sequence
  Description of Artificial Sequence: Synthetic oligonucleotide
  Description of Combined DNA/RNA Molecule: Synthetic oligonucleotide
ccuccagaggauguucaautt

SEQ ID NO: 581 - DNA, 21 bp, Artificial Sequence
  Description of Artificial Sequence: Synthetic oligonucleotide
  Description of Combined DNA/RNA Molecule: Synthetic oligonucleotide
auugaacauccucuggaggtt

SEQ ID NO: 582 - DNA, 21 bp, Artificial Sequence
  Description of Artificial Sequence: Synthetic oligonucleotide
  Description of Combined DNA/RNA Molecule: Synthetic oligonucleotide
cuccagaggauguucaauatt

SEQ ID NO: 583 - DNA, 21 bp, Artificial Sequence
  Description of Artificial Sequence: Synthetic oligonucleotide
  Description of Combined DNA/RNA Molecule: Synthetic oligonucleotide
uauugaacauccucuggagtt

SEQ ID NO: 584 - DNA, 21 bp, Artificial Sequence
  Description of Artificial Sequence: Synthetic oligonucleotide
  Description of Combined DNA/RNA Molecule: Synthetic oligonucleotide
agaggauguucaauaacugtt

SEQ ID NO: 585 - DNA, 21 bp, Artificial Sequence
  Description of Artificial Sequence: Synthetic oligonucleotide
  Description of Combined DNA/RNA Molecule: Synthetic oligonucleotide
caguuauugaacauccucutt

SEQ ID NO: 586 - DNA, 21 bp, Artificial Sequence
  Description of Artificial Sequence: Synthetic oligonucleotide
  Description of Combined DNA/RNA Molecule: Synthetic oligonucleotide
aggauguucaauaacugugtt

SEQ ID NO: 587 - DNA, 21 bp, Artificial Sequence
  Description of Artificial Sequence: Synthetic oligonucleotide
  Description of Combined DNA/RNA Molecule: Synthetic oligonucleotide
cacaguuauugaacauccutt

SEQ ID NO: 588 - DNA, 21 bp, Artificial Sequence
  Description of Artificial Sequence: Synthetic oligonucleotide
  Description of Combined DNA/RNA Molecule: Synthetic oligonucleotide
uguucaauaacugugaggutt

SEQ ID NO: 589 - DNA, 21 bp, Artificial Sequence
  Description of Artificial Sequence: Synthetic oligonucleotide
  Description of Combined DNA/RNA Molecule: Synthetic oligonucleotide
accucacaguuauugaacatt

SEQ ID NO: 590 - DNA, 21 bp, Artificial Sequence
  Description of Artificial Sequence: Synthetic oligonucleotide
  Description of Combined DNA/RNA Molecule: Synthetic oligonucleotide
uucaauaacugugagguggtt

SEQ ID NO: 591 - DNA, 21 bp, Artificial Sequence
  Description of Artificial Sequence: Synthetic oligonucleotide
  Description of Combined DNA/RNA Molecule: Synthetic oligonucleotide
ccaccucacaguuauugaatt

SEQ ID NO: 592 - DNA, 21 bp, Artificial Sequence
  Description of Artificial Sequence: Synthetic oligonucleotide
  Description of Combined DNA/RNA Molecule: Synthetic oligonucleotide
ucaauaacugugagguggutt

SEQ ID NO: 593 - DNA, 21 bp, Artificial Sequence
  Description of Artificial Sequence: Synthetic oligonucleotide
  Description of Combined DNA/RNA Molecule: Synthetic oligonucleotide
accaccucacaguuauugatt

SEQ ID NO: 594 - DNA, 21 bp, Artificial Sequence
  Description of Artificial Sequence: Synthetic oligonucleotide
  Description of Combined DNA/RNA Molecule: Synthetic oligonucleotide
caauaacugugaggugguctt

SEQ ID NO: 595 - DNA, 21 bp, Artificial Sequence
  Description of Artificial Sequence: Synthetic oligonucleotide
  Description of Combined DNA/RNA Molecule: Synthetic oligonucleotide
gaccaccucacaguuauugtt

SEQ ID NO: 596 - DNA, 21 bp, Artificial Sequence
  Description of Artificial Sequence: Synthetic oligonucleotide
  Description of Combined DNA/RNA Molecule: Synthetic oligonucleotide
aauaacugugagguggucctt

SEQ ID NO: 597 - DNA, 21 bp, Artificial Sequence
  Description of Artificial Sequence: Synthetic oligonucleotide
  Description of Combined DNA/RNA Molecule: Synthetic oligonucleotide
ggaccaccucacaguuauutt

SEQ ID NO: 598 - DNA, 21 bp, Artificial Sequence
  Description of Artificial Sequence: Synthetic oligonucleotide
  Description of Combined DNA/RNA Molecule: Synthetic oligonucleotide
auaacugugaggugguccutt

SEQ ID NO: 599 - DNA, 21 bp, Artificial Sequence
  Description of Artificial Sequence: Synthetic oligonucleotide
  Description of Combined DNA/RNA Molecule: Synthetic oligonucleotide
aggaccaccucacaguuautt

SEQ ID NO: 600 - DNA, 21 bp, Artificial Sequence
  Description of Artificial Sequence: Synthetic oligonucleotide
  Description of Combined DNA/RNA Molecule: Synthetic oligonucleotide
uaacugugaggugguccuutt

SEQ ID NO: 601 - DNA, 21 bp, Artificial Sequence
  Description of Artificial Sequence: Synthetic oligonucleotide
  Description of Combined DNA/RNA Molecule: Synthetic oligonucleotide
aaggaccaccucacaguuatt

SEQ ID NO: 602 - DNA, 21 bp, Artificial Sequence
  Description of Artificial Sequence: Synthetic oligonucleotide
  Description of Combined DNA/RNA Molecule: Synthetic oligonucleotide
acugugaggugguccuuggtt

SEQ ID NO: 603 - DNA, 21 bp, Artificial Sequence
  Description of Artificial Sequence: Synthetic oligonucleotide
  Description of Combined DNA/RNA Molecule: Synthetic oligonucleotide
ccaaggaccaccucacagutt

SEQ ID NO: 604 - DNA, 21 bp, Artificial Sequence
  Description of Artificial Sequence: Synthetic oligonucleotide
  Description of Combined DNA/RNA Molecule: Synthetic oligonucleotide
ugugaggugguccuugggatt

SEQ ID NO: 605 - DNA, 21 bp, Artificial Sequence
  Description of Artificial Sequence: Synthetic oligonucleotide
  Description of Combined DNA/RNA Molecule: Synthetic oligonucleotide
ucccaaggaccaccucacatt

SEQ ID NO: 606 - DNA, 21 bp, Artificial Sequence
  Description of Artificial Sequence: Synthetic oligonucleotide
  Description of Combined DNA/RNA Molecule: Synthetic oligonucleotide
gugaggugguccuugggaatt

SEQ ID NO: 607 - DNA, 21 bp, Artificial Sequence
  Description of Artificial Sequence: Synthetic oligonucleotide
  Description of Combined DNA/RNA Molecule: Synthetic oligonucleotide
uucccaaggaccaccucactt

SEQ ID NO: 608 - DNA, 21 bp, Artificial Sequence
  Description of Artificial Sequence: Synthetic oligonucleotide
  Description of Combined DNA/RNA Molecule: Synthetic oligonucleotide
ugguccuugggaauuuggatt

SEQ ID NO: 609 - DNA, 21 bp, Artificial Sequence
  Description of Artificial Sequence: Synthetic oligonucleotide
  Description of Combined DNA/RNA Molecule: Synthetic oligonucleotide
uccaaauucccaaggaccatt

SEQ ID NO: 610 - DNA, 21 bp, Artificial Sequence
  Description of Artificial Sequence: Synthetic oligonucleotide
  Description of Combined DNA/RNA Molecule: Synthetic oligonucleotide
uugggaauuuggaaauuactt

SEQ ID NO: 611 - DNA, 21 bp, Artificial Sequence
  Description of Artificial Sequence: Synthetic oligonucleotide
  Description of Combined DNA/RNA Molecule: Synthetic oligonucleotide
guaauuuccaaauucccaatt

SEQ ID NO: 612 - DNA, 21 bp, Artificial Sequence
  Description of Artificial Sequence: Synthetic oligonucleotide
  Description of Combined DNA/RNA Molecule: Synthetic oligonucleotide
ugggaauuuggaaauuacctt

SEQ ID NO: 613 - DNA, 21 bp, Artificial Sequence
  Description of Artificial Sequence: Synthetic oligonucleotide
  Description of Combined DNA/RNA Molecule: Synthetic oligonucleotide
gguaauuuccaaauucccatt

SEQ ID NO: 614 - DNA, 21 bp, Artificial Sequence
  Description of Artificial Sequence: Synthetic oligonucleotide
  Description of Combined DNA/RNA Molecule: Synthetic oligonucleotide
gggaauuuggaaauuaccutt

SEQ ID NO: 615 - DNA, 21 bp, Artificial Sequence
  Description of Artificial Sequence: Synthetic oligonucleotide
  Description of Combined DNA/RNA Molecule: Synthetic oligonucleotide
agguaauuuccaaauuccctt

SEQ ID NO: 616 - DNA, 21 bp, Artificial Sequence
  Description of Artificial Sequence: Synthetic oligonucleotide
  Description of Combined DNA/RNA Molecule: Synthetic oligonucleotide
ggaauuuggaaauuaccuatt

SEQ ID NO: 617 - DNA, 21 bp, Artificial Sequence
  Description of Artificial Sequence: Synthetic oligonucleotide
  Description of Combined DNA/RNA Molecule: Synthetic oligonucleotide
uagguaauuuccaaauucctt

SEQ ID NO: 618 - DNA, 21 bp, Artificial Sequence
  Description of Artificial Sequence: Synthetic oligonucleotide
  Description of Combined DNA/RNA Molecule: Synthetic oligonucleotide
agaggaauuaugaucuuuctt

SEQ ID NO: 619 - DNA, 21 bp, Artificial Sequence
  Description of Artificial Sequence: Synthetic oligonucleotide
  Description of Combined DNA/RNA Molecule: Synthetic oligonucleotide
gaaagaucauaauuccucutt

SEQ ID NO: 620 - DNA, 21 bp, Artificial Sequence
  Description of Artificial Sequence: Synthetic oligonucleotide
  Description of Combined DNA/RNA Molecule: Synthetic oligonucleotide
gaggaauuaugaucuuucctt

SEQ ID NO: 621 - DNA, 21 bp, Artificial Sequence
  Description of Artificial Sequence: Synthetic oligonucleotide
  Description of Combined DNA/RNA Molecule: Synthetic oligonucleotide
ggaaagaucauaauuccuctt

SEQ ID NO: 622 - DNA, 21 bp, Artificial Sequence
  Description of Artificial Sequence: Synthetic oligonucleotide
  Description of Combined DNA/RNA Molecule: Synthetic oligonucleotide
aauuaugaucuuuccuucutt

SEQ ID NO: 623 - DNA, 21 bp, Artificial Sequence
  Description of Artificial Sequence: Synthetic oligonucleotide
  Description of Combined DNA/RNA Molecule: Synthetic oligonucleotide
agaaggaaagaucauaauutt

SEQ ID NO: 624 - DNA, 21 bp, Artificial Sequence
  Description of Artificial Sequence: Synthetic oligonucleotide
  Description of Combined DNA/RNA Molecule: Synthetic oligonucleotide
auuaugaucuuuccuucuutt

SEQ ID NO: 625 - DNA, 21 bp, Artificial Sequence
  Description of Artificial Sequence: Synthetic oligonucleotide
  Description of Combined DNA/RNA Molecule: Synthetic oligonucleotide
aagaaggaaagaucauaautt

SEQ ID NO: 626 - DNA, 21 bp, Artificial Sequence
  Description of Artificial Sequence: Synthetic oligonucleotide
  Description of Combined DNA/RNA Molecule: Synthetic oligonucleotide
uaugaucuuuccuucuuaatt

SEQ ID NO: 627 - DNA, 21 bp, Artificial Sequence
  Description of Artificial Sequence: Synthetic oligonucleotide
  Description of Combined DNA/RNA Molecule: Synthetic oligonucleotide
uuaagaaggaaagaucauatt

SEQ ID NO: 628 - DNA, 21 bp, Artificial Sequence
  Description of Artificial Sequence: Synthetic oligonucleotide
  Description of Combined DNA/RNA Molecule: Synthetic oligonucleotide
ugaucuuuccuucuuaaagtt

SEQ ID NO: 629 - DNA, 21 bp, Artificial Sequence
  Description of Artificial Sequence: Synthetic oligonucleotide
  Description of Combined DNA/RNA Molecule: Synthetic oligonucleotide
cuuuaagaaggaaagaucatt

SEQ ID NO: 630 - DNA, 21 bp, Artificial Sequence
  Description of Artificial Sequence: Synthetic oligonucleotide
  Description of Combined DNA/RNA Molecule: Synthetic oligonucleotide
ucuuuccuucuuaaagacctt

SEQ ID NO: 631 - DNA, 21 bp, Artificial Sequence
  Description of Artificial Sequence: Synthetic oligonucleotide
  Description of Combined DNA/RNA Molecule: Synthetic oligonucleotide
ggucuuuaagaaggaaagatt

SEQ ID NO: 632 - DNA, 21 bp, Artificial Sequence
  Description of Artificial Sequence: Synthetic oligonucleotide
  Description of Combined DNA/RNA Molecule: Synthetic oligonucleotide
ccuucuuaaagaccauccatt

SEQ ID NO: 633 - DNA, 21 bp, Artificial Sequence
  Description of Artificial Sequence: Synthetic oligonucleotide
  Description of Combined DNA/RNA Molecule: Synthetic oligonucleotide
uggauggucuuuaagaaggtt

SEQ ID NO: 634 - DNA, 21 bp, Artificial Sequence
  Description of Artificial Sequence: Synthetic oligonucleotide
  Description of Combined DNA/RNA Molecule: Synthetic oligonucleotide
cuucuuaaagaccauccagtt

SEQ ID NO: 635 - DNA, 21 bp, Artificial Sequence
  Description of Artificial Sequence: Synthetic oligonucleotide
  Description of Combined DNA/RNA Molecule: Synthetic oligonucleotide
cuggauggucuuuaagaagtt

SEQ ID NO: 636 - DNA, 21 bp, Artificial Sequence
  Description of Artificial Sequence: Synthetic oligonucleotide
  Description of Combined DNA/RNA Molecule: Synthetic oligonucleotide
ucuuaaagaccauccaggatt

SEQ ID NO: 637 - DNA, 21 bp, Artificial Sequence
  Description of Artificial Sequence: Synthetic oligonucleotide
  Description of Combined DNA/RNA Molecule: Synthetic oligonucleotide
uccuggauggucuuuaagatt

SEQ ID NO: 638 - DNA, 21 bp, Artificial Sequence
  Description of Artificial Sequence: Synthetic oligonucleotide
  Description of Combined DNA/RNA Molecule: Synthetic oligonucleotide
uuaaagaccauccaggaggtt

SEQ ID NO: 639 - DNA, 21 bp, Artificial Sequence
  Description of Artificial Sequence: Synthetic oligonucleotide
  Description of Combined DNA/RNA Molecule: Synthetic oligonucleotide
ccuccuggauggucuuuaatt

SEQ ID NO: 640 - DNA, 21 bp, Artificial Sequence
  Description of Artificial Sequence: Synthetic oligonucleotide
  Description of Combined DNA/RNA Molecule: Synthetic oligonucleotide
uaaagaccauccaggaggutt

SEQ ID NO: 641 - DNA, 21 bp, Artificial Sequence
  Description of Artificial Sequence: Synthetic oligonucleotide
  Description of Combined DNA/RNA Molecule: Synthetic oligonucleotide
accuccuggauggucuuuatt

SEQ ID NO: 642 - DNA, 21 bp, Artificial Sequence
  Description of Artificial Sequence: Synthetic oligonucleotide
  Description of Combined DNA/RNA Molecule: Synthetic oligonucleotide
ccaggagguggcugguuautt

SEQ ID NO: 643 - DNA, 21 bp, Artificial Sequence
  Description of Artificial Sequence: Synthetic oligonucleotide
  Description of Combined DNA/RNA Molecule: Synthetic oligonucleotide
auaaccagccaccuccuggtt

SEQ ID NO: 644 - DNA, 21 bp, Artificial Sequence
  Description of Artificial Sequence: Synthetic oligonucleotide
  Description of Combined DNA/RNA Molecule: Synthetic oligonucleotide
caggagguggcugguuaugtt

SEQ ID NO: 645 - DNA, 21 bp, Artificial Sequence
  Description of Artificial Sequence: Synthetic oligonucleotide
  Description of Combined DNA/RNA Molecule: Synthetic oligonucleotide
cauaaccagccaccuccugtt

SEQ ID NO: 646 - DNA, 21 bp, Artificial Sequence
  Description of Artificial Sequence: Synthetic oligonucleotide
  Description of Combined DNA/RNA Molecule: Synthetic oligonucleotide
aggagguggcugguuaugutt

SEQ ID NO: 647 - DNA, 21 bp, Artificial Sequence
  Description of Artificial Sequence: Synthetic oligonucleotide
  Description of Combined DNA/RNA Molecule: Synthetic oligonucleotide
acauaaccagccaccuccutt

SEQ ID NO: 648 - DNA, 21 bp, Artificial Sequence
  Description of Artificial Sequence: Synthetic oligonucleotide
  Description of Combined DNA/RNA Molecule: Synthetic oligonucleotide
ggagguggcugguuauguctt

SEQ ID NO: 649 - DNA, 21 bp, Artificial Sequence
  Description of Artificial Sequence: Synthetic oligonucleotide
  Description of Combined DNA/RNA Molecule: Synthetic oligonucleotide
gacauaaccagccaccucctt

SEQ ID NO: 650 - DNA, 21 bp, Artificial Sequence
  Description of Artificial Sequence: Synthetic oligonucleotide
  Description of Combined DNA/RNA Molecule: Synthetic oligonucleotide
gagguggcugguuaugucctt

SEQ ID NO: 651 - DNA, 21 bp, Artificial Sequence
  Description of Artificial Sequence: Synthetic oligonucleotide
  Description of Combined DNA/RNA Molecule: Synthetic oligonucleotide
ggacauaaccagccaccuctt

SEQ ID NO: 652 - DNA, 21 bp, Artificial Sequence
  Description of Artificial Sequence: Synthetic oligonucleotide
  Description of Combined DNA/RNA Molecule: Synthetic oligonucleotide
agguggcugguuauguccutt

SEQ ID NO: 653 - DNA, 21 bp, Artificial Sequence
  Description of Artificial Sequence: Synthetic oligonucleotide
  Description of Combined DNA/RNA Molecule: Synthetic oligonucleotide
aggacauaaccagccaccutt

SEQ ID NO: 654 - DNA, 21 bp, Artificial Sequence
  Description of Artificial Sequence: Synthetic oligonucleotide
  Description of Combined DNA/RNA Molecule: Synthetic oligonucleotide
guggcugguuauguccucatt

SEQ ID NO: 655 - DNA, 21 bp, Artificial Sequence
  Description of Artificial Sequence: Synthetic oligonucleotide
  Description of Combined DNA/RNA Molecule: Synthetic oligonucleotide
ugaggacauaaccagccactt

SEQ ID NO: 656 - DNA, 21 bp, Artificial Sequence
  Description of Artificial Sequence: Synthetic oligonucleotide
  Description of Combined DNA/RNA Molecule: Synthetic oligonucleotide
gcccucaacacaguggagctt

SEQ ID NO: 657 - DNA, 21 bp, Artificial Sequence
  Description of Artificial Sequence: Synthetic oligonucleotide
  Description of Combined DNA/RNA Molecule: Synthetic oligonucleotide
gcuccacuguguugagggctt

SEQ ID NO: 658 - DNA, 21 bp, Artificial Sequence
  Description of Artificial Sequence: Synthetic oligonucleotide
  Description of Combined DNA/RNA Molecule: Synthetic oligonucleotide
uuccuuuggaaaaccugcatt

SEQ ID NO: 659 - DNA, 21 bp, Artificial Sequence
  Description of Artificial Sequence: Synthetic oligonucleotide
  Description of Combined DNA/RNA Molecule: Synthetic oligonucleotide
ugcagguuuuccaaaggaatt

SEQ ID NO: 660 - DNA, 21 bp, Artificial Sequence
  Description of Artificial Sequence: Synthetic oligonucleotide
  Description of Combined DNA/RNA Molecule: Synthetic oligonucleotide
uccuuuggaaaaccugcagtt

SEQ ID NO: 661 - DNA, 21 bp, Artificial Sequence
  Description of Artificial Sequence: Synthetic oligonucleotide
  Description of Combined DNA/RNA Molecule: Synthetic oligonucleotide
cugcagguuuuccaaaggatt

SEQ ID NO: 662 - DNA, 21 bp, Artificial Sequence
  Description of Artificial Sequence: Synthetic oligonucleotide
  Description of Combined DNA/RNA Molecule: Synthetic oligonucleotide
gaaaaccugcagaucaucatt

SEQ ID NO: 663 - DNA, 21 bp, Artificial Sequence
  Description of Artificial Sequence: Synthetic oligonucleotide
  Description of Combined DNA/RNA Molecule: Synthetic oligonucleotide
ugaugaucugcagguuuuctt

SEQ ID NO: 664 - DNA, 21 bp, Artificial Sequence
  Description of Artificial Sequence: Synthetic oligonucleotide
  Description of Combined DNA/RNA Molecule: Synthetic oligonucleotide
aaaaccugcagaucaucagtt

SEQ ID NO: 665 - DNA, 21 bp, Artificial Sequence
  Description of Artificial Sequence: Synthetic oligonucleotide
  Description of Combined DNA/RNA Molecule: Synthetic oligonucleotide
cugaugaucugcagguuuutt

SEQ ID NO: 666 - DNA, 21 bp, Artificial Sequence
  Description of Artificial Sequence: Synthetic oligonucleotide
  Description of Combined DNA/RNA Molecule: Synthetic oligonucleotide
aaccugcagaucaucagagtt

SEQ ID NO: 667 - DNA, 21 bp, Artificial Sequence
  Description of Artificial Sequence: Synthetic oligonucleotide
  Description of Combined DNA/RNA Molecule: Synthetic oligonucleotide
cucugaugaucugcagguutt

SEQ ID NO: 668 - DNA, 21 bp, Artificial Sequence
  Description of Artificial Sequence: Synthetic oligonucleotide
  Description of Combined DNA/RNA Molecule: Synthetic oligonucleotide
cugcagaucaucagaggaatt

SEQ ID NO: 669 - DNA, 21 bp, Artificial Sequence
  Description of Artificial Sequence: Synthetic oligonucleotide
  Description of Combined DNA/RNA Molecule: Synthetic oligonucleotide
uuccucugaugaucugcagtt

SEQ ID NO: 670 - DNA, 21 bp, Artificial Sequence
  Description of Artificial Sequence: Synthetic oligonucleotide
  Description of Combined DNA/RNA Molecule: Synthetic oligonucleotide
gaaaauuccuaugccuuagtt

SEQ ID NO: 671 - DNA, 21 bp, Artificial Sequence
  Description of Artificial Sequence: Synthetic oligonucleotide
  Description of Combined DNA/RNA Molecule: Synthetic oligonucleotide
cuaaggcauaggaauuuuctt

SEQ ID NO: 672 - DNA, 21 bp, Artificial Sequence
  Description of Artificial Sequence: Synthetic oligonucleotide
  Description of Combined DNA/RNA Molecule: Synthetic oligonucleotide
aaaauuccuaugccuuagctt

SEQ ID NO: 673 - DNA, 21 bp, Artificial Sequence
  Description of Artificial Sequence: Synthetic oligonucleotide
  Description of Combined DNA/RNA Molecule: Synthetic oligonucleotide
gcuaaggcauaggaauuuutt

SEQ ID NO: 674 - DNA, 21 bp, Artificial Sequence
  Description of Artificial Sequence: Synthetic oligonucleotide
  Description of Combined DNA/RNA Molecule: Synthetic oligonucleotide
aauuccuaugccuuagcagtt

SEQ ID NO: 675 - DNA, 21 bp, Artificial Sequence
  Description of Artificial Sequence: Synthetic oligonucleotide
  Description of Combined DNA/RNA Molecule: Synthetic oligonucleotide
cugcuaaggcauaggaauutt

SEQ ID NO: 676 - DNA, 21 bp, Artificial Sequence
  Description of Artificial Sequence: Synthetic oligonucleotide
  Description of Combined DNA/RNA Molecule: Synthetic oligonucleotide
uccuaugccuuagcagucutt

SEQ ID NO: 677 - DNA, 21 bp, Artificial Sequence
  Description of Artificial Sequence: Synthetic oligonucleotide
  Description of Combined DNA/RNA Molecule: Synthetic oligonucleotide
agacugcuaaggcauaggatt

SEQ ID NO: 678 - DNA, 21 bp, Artificial Sequence
  Description of Artificial Sequence: Synthetic oligonucleotide
  Description of Combined DNA/RNA Molecule: Synthetic oligonucleotide
ccuaugccuuagcagucuutt

SEQ ID NO: 679 - DNA, 21 bp, Artificial Sequence
  Description of Artificial Sequence: Synthetic oligonucleotide
  Description of Combined DNA/RNA Molecule: Synthetic oligonucleotide
aagacugcuaaggcauaggtt

SEQ ID NO: 680 - DNA, 21 bp, Artificial Sequence
  Description of Artificial Sequence: Synthetic oligonucleotide
  Description of Combined DNA/RNA Molecule: Synthetic oligonucleotide
cuaugccuuagcagucuuatt

SEQ ID NO: 681 - DNA, 21 bp, Artificial Sequence
  Description of Artificial Sequence: Synthetic oligonucleotide
  Description of Combined DNA/RNA Molecule: Synthetic oligonucleotide
uaagacugcuaaggcauagtt

SEQ ID NO: 682 - DNA, 21 bp, Artificial Sequence
  Description of Artificial Sequence: Synthetic oligonucleotide
  Description of Combined DNA/RNA Molecule: Synthetic oligonucleotide
augccuuagcagucuuauctt

SEQ ID NO: 683 - DNA, 21 bp, Artificial Sequence
  Description of Artificial Sequence: Synthetic oligonucleotide
  Description of Combined DNA/RNA Molecule: Synthetic oligonucleotide
gauaagacugcuaaggcautt

SEQ ID NO: 684 - DNA, 21 bp, Artificial Sequence
  Description of Artificial Sequence: Synthetic oligonucleotide
  Description of Combined DNA/RNA Molecule: Synthetic oligonucleotide
ugccuuagcagucuuaucutt

SEQ ID NO: 685 - DNA, 21 bp, Artificial Sequence
  Description of Artificial Sequence: Synthetic oligonucleotide
  Description of Combined DNA/RNA Molecule: Synthetic oligonucleotide
agauaagacugcuaaggcatt

SEQ ID NO: 686 - DNA, 21 bp, Artificial Sequence
  Description of Artificial Sequence: Synthetic oligonucleotide
  Description of Combined DNA/RNA Molecule: Synthetic oligonucleotide
gccuuagcagucuuaucuatt

SEQ ID NO: 687 - DNA, 21 bp, Artificial Sequence
  Description of Artificial Sequence: Synthetic oligonucleotide
  Description of Combined DNA/RNA Molecule: Synthetic oligonucleotide
uagauaagacugcuaaggctt

SEQ ID NO: 688 - DNA, 21 bp, Artificial Sequence
  Description of Artificial Sequence: Synthetic oligonucleotide
  Description of Combined DNA/RNA Molecule: Synthetic oligonucleotide
ccuuagcagucuuaucuaatt

SEQ ID NO: 689 - DNA, 21 bp, Artificial Sequence
  Description of Artificial Sequence: Synthetic oligonucleotide
  Description of Combined DNA/RNA Molecule: Synthetic oligonucleotide
uuagauaagacugcuaaggtt

SEQ ID NO: 690 - DNA, 21 bp, Artificial Sequence
  Description of Artificial Sequence: Synthetic oligonucleotide
  Description of Combined DNA/RNA Molecule: Synthetic oligonucleotide
cuuagcagucuuaucuaactt

SEQ ID NO: 691 - DNA, 21 bp, Artificial Sequence
  Description of Artificial Sequence: Synthetic oligonucleotide
  Description of Combined DNA/RNA Molecule: Synthetic oligonucleotide
guuagauaagacugcuaagtt

SEQ ID NO: 692 - DNA, 21 bp, Artificial Sequence
  Description of Artificial Sequence: Synthetic oligonucleotide
  Description of Combined DNA/RNA Molecule: Synthetic oligonucleotide
uuagcagucuuaucuaacutt

SEQ ID NO: 693 - DNA, 21 bp, Artificial Sequence
  Description of Artificial Sequence: Synthetic oligonucleotide
  Description of Combined DNA/RNA Molecule: Synthetic oligonucleotide
aguuagauaagacugcuaatt

SEQ ID NO: 694 - DNA, 21 bp, Artificial Sequence
  Description of Artificial Sequence: Synthetic oligonucleotide
  Description of Combined DNA/RNA Molecule: Synthetic oligonucleotide
uagcagucuuaucuaacuatt

SEQ ID NO: 695 - DNA, 21 bp, Artificial Sequence
  Description of Artificial Sequence: Synthetic oligonucleotide
  Description of Combined DNA/RNA Molecule: Synthetic oligonucleotide
uaguuagauaagacugcuatt

SEQ ID NO: 696 - DNA, 21 bp, Artificial Sequence
  Description of Artificial Sequence: Synthetic oligonucleotide
  Description of Combined DNA/RNA Molecule: Synthetic oligonucleotide
agcagucuuaucuaacuautt

SEQ ID NO: 697 - DNA, 21 bp, Artificial Sequence
  Description of Artificial Sequence: Synthetic oligonucleotide
  Description of Combined DNA/RNA Molecule: Synthetic oligonucleotide
auaguuagauaagacugcutt

SEQ ID NO: 698 - DNA, 21 bp, Artificial Sequence
  Description of Artificial Sequence: Synthetic oligonucleotide
  Description of Combined DNA/RNA Molecule: Synthetic oligonucleotide
gcagucuuaucuaacuaugtt

SEQ ID NO: 699 - DNA, 21 bp, Artificial Sequence
  Description of Artificial Sequence: Synthetic oligonucleotide
  Description of Combined DNA/RNA Molecule: Synthetic oligonucleotide
cauaguuagauaagacugctt

SEQ ID NO: 700 - DNA, 21 bp, Artificial Sequence
  Description of Artificial Sequence: Synthetic oligonucleotide
  Description of Combined DNA/RNA Molecule: Synthetic oligonucleotide
cagucuuaucuaacuaugatt

SEQ ID NO: 701 - DNA, 21 bp, Artificial Sequence
  Description of Artificial Sequence: Synthetic oligonucleotide
  Description of Combined DNA/RNA Molecule: Synthetic oligonucleotide
ucauaguuagauaagacugtt

SEQ ID NO: 702 - DNA, 21 bp, Artificial Sequence
  Description of Artificial Sequence: Synthetic oligonucleotide
  Description of Combined DNA/RNA Molecule: Synthetic oligonucleotide
ucuuaucuaacuaugaugctt

SEQ ID NO: 703 - DNA, 21 bp, Artificial Sequence
  Description of Artificial Sequence: Synthetic oligonucleotide
  Description of Combined DNA/RNA Molecule: Synthetic oligonucleotide
gcaucauaguuagauaagatt

SEQ ID NO: 704 - DNA, 21 bp, Artificial Sequence
  Description of Artificial Sequence: Synthetic oligonucleotide
  Description of Combined DNA/RNA Molecule: Synthetic oligonucleotide
cuuaucuaacuaugaugcatt

SEQ ID NO: 705 - DNA, 21 bp, Artificial Sequence
  Description of Artificial Sequence: Synthetic oligonucleotide
  Description of Combined DNA/RNA Molecule: Synthetic oligonucleotide
ugcaucauaguuagauaagtt

SEQ ID NO: 706 - DNA, 21 bp, Artificial Sequence
  Description of Artificial Sequence: Synthetic oligonucleotide
  Description of Combined DNA/RNA Molecule: Synthetic oligonucleotide
uuaucuaacuaugaugcaatt

SEQ ID NO: 707 - DNA, 21 bp, Artificial Sequence
  Description of Artificial Sequence: Synthetic oligonucleotide
  Description of Combined DNA/RNA Molecule: Synthetic oligonucleotide
uugcaucauaguuagauaatt

SEQ ID NO: 708 - DNA, 21 bp, Artificial Sequence
  Description of Artificial Sequence: Synthetic oligonucleotide
  Description of Combined DNA/RNA Molecule: Synthetic oligonucleotide
uaucuaacuaugaugcaaatt

SEQ ID NO: 709 - DNA, 21 bp, Artificial Sequence
  Description of Artificial Sequence: Synthetic oligonucleotide
  Description of Combined DNA/RNA Molecule: Synthetic oligonucleotide
uuugcaucauaguuagauatt

SEQ ID NO: 710 - DNA, 21 bp, Artificial Sequence
  Description of Artificial Sequence: Synthetic oligonucleotide
  Description of Combined DNA/RNA Molecule: Synthetic oligonucleotide
aucuaacuaugaugcaaautt

SEQ ID NO: 711 - DNA, 21 bp, Artificial Sequence
  Description of Artificial Sequence: Synthetic oligonucleotide
  Description of Combined DNA/RNA Molecule: Synthetic oligonucleotide
auuugcaucauaguuagautt

SEQ ID NO: 712 - DNA, 21 bp, Artificial Sequence
  Description of Artificial Sequence: Synthetic oligonucleotide
  Description of Combined DNA/RNA Molecule: Synthetic oligonucleotide
ucuaacuaugaugcaaauatt

SEQ ID NO: 713 - DNA, 21 bp, Artificial Sequence
  Description of Artificial Sequence: Synthetic oligonucleotide
  Description of Combined DNA/RNA Molecule: Synthetic oligonucleotide
uauuugcaucauaguuagatt

SEQ ID NO: 714 - DNA, 21 bp, Artificial Sequence
  Description of Artificial Sequence: Synthetic oligonucleotide
  Description of Combined DNA/RNA Molecule: Synthetic oligonucleotide
cuaacuaugaugcaaauaatt

SEQ ID NO: 715 - DNA, 21 bp, Artificial Sequence
  Description of Artificial Sequence: Synthetic oligonucleotide
  Description of Combined DNA/RNA Molecule: Synthetic oligonucleotide
uuauuugcaucauaguuagtt

SEQ ID NO: 716 - DNA, 21 bp, Artificial Sequence
  Description of Artificial Sequence: Synthetic oligonucleotide
  Description of Combined DNA/RNA Molecule: Synthetic oligonucleotide
aacuaugaugcaaauaaaatt

SEQ ID NO: 717 - DNA, 21 bp, Artificial Sequence
  Description of Artificial Sequence: Synthetic oligonucleotide
  Description of Combined DNA/RNA Molecule: Synthetic oligonucleotide
uuuuauuugcaucauaguutt

SEQ ID NO: 718 - DNA, 21 bp, Artificial Sequence
  Description of Artificial Sequence: Synthetic oligonucleotide
  Description of Combined DNA/RNA Molecule: Synthetic oligonucleotide
gaugcaaauaaaaccggactt

SEQ ID NO: 719 - DNA, 21 bp, Artificial Sequence
  Description of Artificial Sequence: Synthetic oligonucleotide
  Description of Combined DNA/RNA Molecule: Synthetic oligonucleotide
guccgguuuuauuugcauctt

SEQ ID NO: 720 - DNA, 21 bp, Artificial Sequence
  Description of Artificial Sequence: Synthetic oligonucleotide
  Description of Combined DNA/RNA Molecule: Synthetic oligonucleotide
augcaaauaaaaccggacutt

SEQ ID NO: 721 - DNA, 21 bp, Artificial Sequence
  Description of Artificial Sequence: Synthetic oligonucleotide
  Description of Combined DNA/RNA Molecule: Synthetic oligonucleotide
aguccgguuuuauuugcautt

SEQ ID NO: 722 - DNA, 21 bp, Artificial Sequence
  Description of Artificial Sequence: Synthetic oligonucleotide
  Description of Combined DNA/RNA Molecule: Synthetic oligonucleotide
ugcaaauaaaaccggacugtt

SEQ ID NO: 723 - DNA, 21 bp, Artificial Sequence
  Description of Artificial Sequence: Synthetic oligonucleotide
  Description of Combined DNA/RNA Molecule: Synthetic oligonucleotide
caguccgguuuuauuugcatt

SEQ ID NO: 724 - DNA, 21 bp, Artificial Sequence
  Description of Artificial Sequence: Synthetic oligonucleotide
  Description of Combined DNA/RNA Molecule: Synthetic oligonucleotide
caaauaaaaccggacugaatt

SEQ ID NO: 725 - DNA, 21 bp, Artificial Sequence
  Description of Artificial Sequence: Synthetic oligonucleotide
  Description of Combined DNA/RNA Molecule: Synthetic oligonucleotide
uucaguccgguuuuauuugtt

SEQ ID NO: 726 - DNA, 21 bp, Artificial Sequence
  Description of Artificial Sequence: Synthetic oligonucleotide
  Description of Combined DNA/RNA Molecule: Synthetic oligonucleotide
aaauaaaaccggacugaagtt

SEQ ID NO: 727 - DNA, 21 bp, Artificial Sequence
  Description of Artificial Sequence: Synthetic oligonucleotide
  Description of Combined DNA/RNA Molecule: Synthetic oligonucleotide
cuucaguccgguuuuauuutt

SEQ ID NO: 728 - DNA, 21 bp, Artificial Sequence
  Description of Artificial Sequence: Synthetic oligonucleotide
  Description of Combined DNA/RNA Molecule: Synthetic oligonucleotide
aauaaaaccggacugaaggtt

SEQ ID NO: 729 - DNA, 21 bp, Artificial Sequence
  Description of Artificial Sequence: Synthetic oligonucleotide
  Description of Combined DNA/RNA Molecule: Synthetic oligonucleotide
ccuucaguccgguuuuauutt

SEQ ID NO: 730 - DNA, 21 bp, Artificial Sequence
  Description of Artificial Sequence: Synthetic oligonucleotide
  Description of Combined DNA/RNA Molecule: Synthetic oligonucleotide
uaaaaccggacugaaggagtt

SEQ ID NO: 731 - DNA, 21 bp, Artificial Sequence
  Description of Artificial Sequence: Synthetic oligonucleotide
  Description of Combined DNA/RNA Molecule: Synthetic oligonucleotide
cuccuucaguccgguuuuatt

SEQ ID NO: 732 - DNA, 21 bp, Artificial Sequence
  Description of Artificial Sequence: Synthetic oligonucleotide
  Description of Combined DNA/RNA Molecule: Synthetic oligonucleotide
aaaaccggacugaaggagctt

SEQ ID NO: 733 - DNA, 21 bp, Artificial Sequence
  Description of Artificial Sequence: Synthetic oligonucleotide
  Description of Combined DNA/RNA Molecule: Synthetic oligonucleotide
gcuccuucaguccgguuuutt

SEQ ID NO: 734 - DNA, 21 bp, Artificial Sequence
  Description of Artificial Sequence: Synthetic oligonucleotide
  Description of Combined DNA/RNA Molecule: Synthetic oligonucleotide
aaaccggacugaaggagcutt

SEQ ID NO: 735 - DNA, 21 bp, Artificial Sequence
  Description of Artificial Sequence: Synthetic oligonucleotide
  Description of Combined DNA/RNA Molecule: Synthetic oligonucleotide
agcuccuucaguccgguuutt

SEQ ID NO: 736 - DNA, 21 bp, Artificial Sequence
  Description of Artificial Sequence: Synthetic oligonucleotide
  Description of Combined DNA/RNA Molecule: Synthetic oligonucleotide
aaccggacugaaggagcugtt

SEQ ID NO: 737 - DNA, 21 bp, Artificial Sequence
  Description of Artificial Sequence: Synthetic oligonucleotide
  Description of Combined DNA/RNA Molecule: Synthetic oligonucleotide
cagcuccuucaguccgguutt

SEQ ID NO: 738 - DNA, 21 bp, Artificial Sequence
  Description of Artificial Sequence: Synthetic oligonucleotide
  Description of Combined DNA/RNA Molecule: Synthetic oligonucleotide
aggagcugcccaugagaaatt

SEQ ID NO: 739 - DNA, 21 bp, Artificial Sequence
  Description of Artificial Sequence: Synthetic oligonucleotide
  Description of Combined DNA/RNA Molecule: Synthetic oligonucleotide
uuucucaugggcagcuccutt

SEQ ID NO: 740 - DNA, 21 bp, Artificial Sequence
  Description of Artificial Sequence: Synthetic oligonucleotide
  Description of Combined DNA/RNA Molecule: Synthetic oligonucleotide
uacaggaaauccugcauggtt

SEQ ID NO: 741 - DNA, 21 bp, Artificial Sequence
  Description of Artificial Sequence: Synthetic oligonucleotide
  Description of Combined DNA/RNA Molecule: Synthetic oligonucleotide
ccaugcaggauuuccuguatt

SEQ ID NO: 742 - DNA, 21 bp, Artificial Sequence
  Description of Artificial Sequence: Synthetic oligonucleotide
  Description of Combined DNA/RNA Molecule: Synthetic oligonucleotide
aggaaauccugcauggcgctt

SEQ ID NO: 743 - DNA, 21 bp, Artificial Sequence
  Description of Artificial Sequence: Synthetic oligonucleotide
  Description of Combined DNA/RNA Molecule: Synthetic oligonucleotide
gcgccaugcaggauuuccutt

SEQ ID NO: 744 - DNA, 21 bp, Artificial Sequence
  Description of Artificial Sequence: Synthetic oligonucleotide
  Description of Combined DNA/RNA Molecule: Synthetic oligonucleotide
ggaaauccugcauggcgcctt

SEQ ID NO: 745 - DNA, 21 bp, Artificial Sequence
  Description of Artificial Sequence: Synthetic oligonucleotide
  Description of Combined DNA/RNA Molecule: Synthetic oligonucleotide
ggcgccaugcaggauuucctt

SEQ ID NO: 746 - DNA, 21 bp, Artificial Sequence
  Description of Artificial Sequence: Synthetic oligonucleotide
  Description of Combined DNA/RNA Molecule: Synthetic oligonucleotide
gaaauccugcauggcgccgtt

SEQ ID NO: 747 - DNA, 21 bp, Artificial Sequence
  Description of Artificial Sequence: Synthetic oligonucleotide
  Description of Combined DNA/RNA Molecule: Synthetic oligonucleotide
cggcgccaugcaggauuuctt

SEQ ID NO: 748 - DNA, 21 bp, Artificial Sequence
  Description of Artificial Sequence: Synthetic oligonucleotide
  Description of Combined DNA/RNA Molecule: Synthetic oligonucleotide
aaauccugcauggcgccgutt

SEQ ID NO: 749 - DNA, 21 bp, Artificial Sequence
  Description of Artificial Sequence: Synthetic oligonucleotide
  Description of Combined DNA/RNA Molecule: Synthetic oligonucleotide
acggcgccaugcaggauuutt

SEQ ID NO: 750 - DNA, 21 bp, Artificial Sequence
  Description of Artificial Sequence: Synthetic oligonucleotide
  Description of Combined DNA/RNA Molecule: Synthetic oligonucleotide
aauccugcauggcgccgugtt

SEQ ID NO: 751 - DNA, 21 bp, Artificial Sequence
  Description of Artificial Sequence: Synthetic oligonucleotide
  Description of Combined DNA/RNA Molecule: Synthetic oligonucleotide
cacggcgccaugcaggauutt

SEQ ID NO: 752 - DNA, 21 bp, Artificial Sequence
  Description of Artificial Sequence: Synthetic oligonucleotide
  Description of Combined DNA/RNA Molecule: Synthetic oligonucleotide
uccugcauggcgccgugcgtt

SEQ ID NO: 753 - DNA, 21 bp, Artificial Sequence
  Description of Artificial Sequence: Synthetic oligonucleotide
  Description of Combined DNA/RNA Molecule: Synthetic oligonucleotide
cgcacggcgccaugcaggatt

SEQ ID NO: 754 - DNA, 21 bp, Artificial Sequence
  Description of Artificial Sequence: Synthetic oligonucleotide
  Description of Combined DNA/RNA Molecule: Synthetic oligonucleotide
cugcauggcgccgugcggutt

SEQ ID NO: 755 - DNA, 21 bp, Artificial Sequence
  Description of Artificial Sequence: Synthetic oligonucleotide
  Description of Combined DNA/RNA Molecule: Synthetic oligonucleotide
accgcacggcgccaugcagtt

SEQ ID NO: 756 - DNA, 21 bp, Artificial Sequence
  Description of Artificial Sequence: Synthetic oligonucleotide
  Description of Combined DNA/RNA Molecule: Synthetic oligonucleotide
ugcauggcgccgugcgguutt

SEQ ID NO: 757 - DNA, 21 bp, Artificial Sequence
  Description of Artificial Sequence: Synthetic oligonucleotide
  Description of Combined DNA/RNA Molecule: Synthetic oligonucleotide
aaccgcacggcgccaugcatt

SEQ ID NO: 758 - DNA, 21 bp, Artificial Sequence
  Description of Artificial Sequence: Synthetic oligonucleotide
  Description of Combined DNA/RNA Molecule: Synthetic oligonucleotide
gcauggcgccgugcgguuctt

SEQ ID NO: 759 - DNA, 21 bp, Artificial Sequence
  Description of Artificial Sequence: Synthetic oligonucleotide
  Description of Combined DNA/RNA Molecule: Synthetic oligonucleotide
gaaccgcacggcgccaugctt

SEQ ID NO: 760 - DNA, 21 bp, Artificial Sequence
  Description of Artificial Sequence: Synthetic oligonucleotide
  Description of Combined DNA/RNA Molecule: Synthetic oligonucleotide
auggcgccgugcgguucagtt

SEQ ID NO: 761 - DNA, 21 bp, Artificial Sequence
  Description of Artificial Sequence: Synthetic oligonucleotide
  Description of Combined DNA/RNA Molecule: Synthetic oligonucleotide
cugaaccgcacggcgccautt

SEQ ID NO: 762 - DNA, 21 bp, Artificial Sequence
  Description of Artificial Sequence: Synthetic oligonucleotide
  Description of Combined DNA/RNA Molecule: Synthetic oligonucleotide
uggcgccgugcgguucagctt

SEQ ID NO: 763 - DNA, 21 bp, Artificial Sequence
  Description of Artificial Sequence: Synthetic oligonucleotide
  Description of Combined DNA/RNA Molecule: Synthetic oligonucleotide
gcugaaccgcacggcgccatt

SEQ ID NO: 764 - DNA, 21 bp, Artificial Sequence
  Description of Artificial Sequence: Synthetic oligonucleotide
  Description of Combined DNA/RNA Molecule: Synthetic oligonucleotide
ggcgccgugcgguucagcatt

SEQ ID NO: 765 - DNA, 21 bp, Artificial Sequence
  Description of Artificial Sequence: Synthetic oligonucleotide
  Description of Combined DNA/RNA Molecule: Synthetic oligonucleotide
ugcugaaccgcacggcgcctt

SEQ ID NO: 766 - DNA, 21 bp, Artificial Sequence
  Description of Artificial Sequence: Synthetic oligonucleotide
  Description of Combined DNA/RNA Molecule: Synthetic oligonucleotide
gcgccgugcgguucagcaatt

SEQ ID NO: 767 - DNA, 21 bp, Artificial Sequence
  Description of Artificial Sequence: Synthetic oligonucleotide
  Description of Combined DNA/RNA Molecule: Synthetic oligonucleotide
uugcugaaccgcacggcgctt

SEQ ID NO: 768 - DNA, 21 bp, Artificial Sequence
  Description of Artificial Sequence: Synthetic oligonucleotide
  Description of Combined DNA/RNA Molecule: Synthetic oligonucleotide
cgccgugcgguucagcaactt

SEQ ID NO: 769 - DNA, 21 bp, Artificial Sequence
  Description of Artificial Sequence: Synthetic oligonucleotide
  Description of Combined DNA/RNA Molecule: Synthetic oligonucleotide
guugcugaaccgcacggcgtt

SEQ ID NO: 770 - DNA, 21 bp, Artificial Sequence
  Description of Artificial Sequence: Synthetic oligonucleotide
  Description of Combined DNA/RNA Molecule: Synthetic oligonucleotide
gccgugcgguucagcaacatt

SEQ ID NO: 771 - DNA, 21 bp, Artificial Sequence
  Description of Artificial Sequence: Synthetic oligonucleotide
  Description of Combined DNA/RNA Molecule: Synthetic oligonucleotide
uguugcugaaccgcacggctt

SEQ ID NO: 772 - DNA, 21 bp, Artificial Sequence
  Description of Artificial Sequence: Synthetic oligonucleotide
  Description of Combined DNA/RNA Molecule: Synthetic oligonucleotide
ccgugcgguucagcaacaatt

SEQ ID NO: 773 - DNA, 21 bp, Artificial Sequence
  Description of Artificial Sequence: Synthetic oligonucleotide
  Description of Combined DNA/RNA Molecule: Synthetic oligonucleotide
uuguugcugaaccgcacggtt

SEQ ID NO: 774 - DNA, 21 bp, Artificial Sequence
  Description of Artificial Sequence: Synthetic oligonucleotide
  Description of Combined DNA/RNA Molecule: Synthetic oligonucleotide
gugcgguucagcaacaacctt

SEQ ID NO: 775 - DNA, 21 bp, Artificial Sequence
  Description of Artificial Sequence: Synthetic oligonucleotide
  Description of Combined DNA/RNA Molecule: Synthetic oligonucleotide
gguuguugcugaaccgcactt

SEQ ID NO: 776 - DNA, 21 bp, Artificial Sequence
  Description of Artificial Sequence: Synthetic oligonucleotide
  Description of Combined DNA/RNA Molecule: Synthetic oligonucleotide
gcgguucagcaacaacccutt

SEQ ID NO: 777 - DNA, 21 bp, Artificial Sequence
  Description of Artificial Sequence: Synthetic oligonucleotide
  Description of Combined DNA/RNA Molecule: Synthetic oligonucleotide
aggguuguugcugaaccgctt

SEQ ID NO: 778 - DNA, 21 bp, Artificial Sequence
  Description of Artificial Sequence: Synthetic oligonucleotide
  Description of Combined DNA/RNA Molecule: Synthetic oligonucleotide
gguucagcaacaacccugctt

SEQ ID NO: 779 - DNA, 21 bp, Artificial Sequence
  Description of Artificial Sequence: Synthetic oligonucleotide
  Description of Combined DNA/RNA Molecule: Synthetic oligonucleotide
gcaggguuguugcugaacctt

SEQ ID NO: 780 - DNA, 21 bp, Artificial Sequence
  Description of Artificial Sequence: Synthetic oligonucleotide
  Description of Combined DNA/RNA Molecule: Synthetic oligonucleotide
gcaacaacccugcccugugtt

SEQ ID NO: 781 - DNA, 21 bp, Artificial Sequence
  Description of Artificial Sequence: Synthetic oligonucleotide
  Description of Combined DNA/RNA Molecule: Synthetic oligonucleotide
cacagggcaggguuguugctt

SEQ ID NO: 782 - DNA, 21 bp, Artificial Sequence
  Description of Artificial Sequence: Synthetic oligonucleotide
  Description of Combined DNA/RNA Molecule: Synthetic oligonucleotide
aacaacccugcccugugcatt

SEQ ID NO: 783 - DNA, 21 bp, Artificial Sequence
  Description of Artificial Sequence: Synthetic oligonucleotide
  Description of Combined DNA/RNA Molecule: Synthetic oligonucleotide
ugcacagggcaggguuguutt

SEQ ID NO: 784 - DNA, 21 bp, Artificial Sequence
  Description of Artificial Sequence: Synthetic oligonucleotide
  Description of Combined DNA/RNA Molecule: Synthetic oligonucleotide
acguggagagcauccagugtt

SEQ ID NO: 785 - DNA, 21 bp, Artificial Sequence
  Description of Artificial Sequence: Synthetic oligonucleotide
  Description of Combined DNA/RNA Molecule: Synthetic oligonucleotide
cacuggaugcucuccacgutt

SEQ ID NO: 786 - DNA, 21 bp, Artificial Sequence
  Description of Artificial Sequence: Synthetic oligonucleotide
  Description of Combined DNA/RNA Molecule: Synthetic oligonucleotide
cguggagagcauccaguggtt

SEQ ID NO: 787 - DNA, 21 bp, Artificial Sequence
  Description of Artificial Sequence: Synthetic oligonucleotide
  Description of Combined DNA/RNA Molecule: Synthetic oligonucleotide
ccacuggaugcucuccacgtt

SEQ ID NO: 788 - DNA, 21 bp, Artificial Sequence
  Description of Artificial Sequence: Synthetic oligonucleotide
  Description of Combined DNA/RNA Molecule: Synthetic oligonucleotide
guggagagcauccaguggctt

SEQ ID NO: 789 - DNA, 21 bp, Artificial Sequence
  Description of Artificial Sequence: Synthetic oligonucleotide
  Description of Combined DNA/RNA Molecule: Synthetic oligonucleotide
gccacuggaugcucuccactt

SEQ ID NO: 790 - DNA, 21 bp, Artificial Sequence
  Description of Artificial Sequence: Synthetic oligonucleotide
  Description of Combined DNA/RNA Molecule: Synthetic oligonucleotide
gagagcauccaguggcgggtt

SEQ ID NO: 791 - DNA, 21 bp, Artificial Sequence
  Description of Artificial Sequence: Synthetic oligonucleotide
  Description of Combined DNA/RNA Molecule: Synthetic oligonucleotide
cccgccacuggaugcucuctt

SEQ ID NO: 792 - DNA, 21 bp, Artificial Sequence
  Description of Artificial Sequence: Synthetic oligonucleotide
  Description of Combined DNA/RNA Molecule: Synthetic oligonucleotide
agagcauccaguggcgggatt

SEQ ID NO: 793 - DNA, 21 bp, Artificial Sequence
  Description of Artificial Sequence: Synthetic oligonucleotide
  Description of Combined DNA/RNA Molecule: Synthetic oligonucleotide
ucccgccacuggaugcucutt

SEQ ID NO: 794 - DNA, 21 bp, Artificial Sequence
  Description of Artificial Sequence: Synthetic oligonucleotide
  Description of Combined DNA/RNA Molecule: Synthetic oligonucleotide
gagcauccaguggcgggactt

SEQ ID NO: 795 - DNA, 21 bp, Artificial Sequence
  Description of Artificial Sequence: Synthetic oligonucleotide
  Description of Combined DNA/RNA Molecule: Synthetic oligonucleotide
gucccgccacuggaugcuctt

SEQ ID NO: 796 - DNA, 21 bp, Artificial Sequence
  Description of Artificial Sequence: Synthetic oligonucleotide
  Description of Combined DNA/RNA Molecule: Synthetic oligonucleotide
caguggcgggacauagucatt

SEQ ID NO: 797 - DNA, 21 bp, Artificial Sequence
  Description of Artificial Sequence: Synthetic oligonucleotide
  Description of Combined DNA/RNA Molecule: Synthetic oligonucleotide
ugacuaugucccgccacugtt

SEQ ID NO: 798 - DNA, 21 bp, Artificial Sequence
  Description of Artificial Sequence: Synthetic oligonucleotide
  Description of Combined DNA/RNA Molecule: Synthetic oligonucleotide
aguggcgggacauagucagtt

SEQ ID NO: 799 - DNA, 21 bp, Artificial Sequence
  Description of Artificial Sequence: Synthetic oligonucleotide
  Description of Combined DNA/RNA Molecule: Synthetic oligonucleotide
cugacuaugucccgccacutt

SEQ ID NO: 800 - DNA, 21 bp, Artificial Sequence
  Description of Artificial Sequence: Synthetic oligonucleotide
  Description of Combined DNA/RNA Molecule: Synthetic oligonucleotide
uggcgggacauagucagcatt

SEQ ID NO: 801 - DNA, 21 bp, Artificial Sequence
  Description of Artificial Sequence: Synthetic oligonucleotide
  Description of Combined DNA/RNA Molecule: Synthetic oligonucleotide
ugcugacuaugucccgccatt

SEQ ID NO: 802 - DNA, 21 bp, Artificial Sequence
  Description of Artificial Sequence: Synthetic oligonucleotide
  Description of Combined DNA/RNA Molecule: Synthetic oligonucleotide
ggcgggacauagucagcagtt

SEQ ID NO: 803 - DNA, 21 bp, Artificial Sequence
  Description of Artificial Sequence: Synthetic oligonucleotide
  Description of Combined DNA/RNA Molecule: Synthetic oligonucleotide
cugcugacuaugucccgcctt

SEQ ID NO: 804 - DNA, 21 bp, Artificial Sequence
  Description of Artificial Sequence: Synthetic oligonucleotide
  Description of Combined DNA/RNA Molecule: Synthetic oligonucleotide
cucagcaacaugucgauggtt

SEQ ID NO: 805 - DNA, 21 bp, Artificial Sequence
  Description of Artificial Sequence: Synthetic oligonucleotide
  Description of Combined DNA/RNA Molecule: Synthetic oligonucleotide
ccaucgacauguugcugagtt

SEQ ID NO: 806 - DNA, 21 bp, Artificial Sequence
  Description of Artificial Sequence: Synthetic oligonucleotide
  Description of Combined DNA/RNA Molecule: Synthetic oligonucleotide
cagcaacaugucgauggactt

SEQ ID NO: 807 - DNA, 21 bp, Artificial Sequence
  Description of Artificial Sequence: Synthetic oligonucleotide
  Description of Combined DNA/RNA Molecule: Synthetic oligonucleotide
guccaucgacauguugcugtt

SEQ ID NO: 808 - DNA, 21 bp, Artificial Sequence
  Description of Artificial Sequence: Synthetic oligonucleotide
  Description of Combined DNA/RNA Molecule: Synthetic oligonucleotide
agcaacaugucgauggacutt

SEQ ID NO: 809 - DNA, 21 bp, Artificial Sequence
  Description of Artificial Sequence: Synthetic oligonucleotide
  Description of Combined DNA/RNA Molecule: Synthetic oligonucleotide
aguccaucgacauguugcutt

SEQ ID NO: 810 - DNA, 21 bp, Artificial Sequence
  Description of Artificial Sequence: Synthetic oligonucleotide
  Description of Combined DNA/RNA Molecule: Synthetic oligonucleotide
gcaacaugucgauggacuutt

SEQ ID NO: 811 - DNA, 21 bp, Artificial Sequence
  Description of Artificial Sequence: Synthetic oligonucleotide
  Description of Combined DNA/RNA Molecule: Synthetic oligonucleotide
aaguccaucgacauguugctt

SEQ ID NO: 812 - DNA, 21 bp, Artificial Sequence
  Description of Artificial Sequence: Synthetic oligonucleotide
  Description of Combined DNA/RNA Molecule: Synthetic oligonucleotide
aacaugucgauggacuucctt

SEQ ID NO: 813 - DNA, 21 bp, Artificial Sequence
  Description of Artificial Sequence: Synthetic oligonucleotide
  Description of Combined DNA/RNA Molecule: Synthetic oligonucleotide
ggaaguccaucgacauguutt

SEQ ID NO: 814 - DNA, 21 bp, Artificial Sequence
  Description of Artificial Sequence: Synthetic oligonucleotide
  Description of Combined DNA/RNA Molecule: Synthetic oligonucleotide
acaugucgauggacuuccatt

SEQ ID NO: 815 - DNA, 21 bp, Artificial Sequence
  Description of Artificial Sequence: Synthetic oligonucleotide
  Description of Combined DNA/RNA Molecule: Synthetic oligonucleotide
uggaaguccaucgacaugutt

SEQ ID NO: 816 - DNA, 21 bp, Artificial Sequence
  Description of Artificial Sequence: Synthetic oligonucleotide
  Description of Combined DNA/RNA Molecule: Synthetic oligonucleotide
caugucgauggacuuccagtt

SEQ ID NO: 817 - DNA, 21 bp, Artificial Sequence
  Description of Artificial Sequence: Synthetic oligonucleotide
  Description of Combined DNA/RNA Molecule: Synthetic oligonucleotide
cuggaaguccaucgacaugtt

SEQ ID NO: 818 - DNA, 21 bp, Artificial Sequence
  Description of Artificial Sequence: Synthetic oligonucleotide
  Description of Combined DNA/RNA Molecule: Synthetic oligonucleotide
augucgauggacuuccagatt

SEQ ID NO: 819 - DNA, 21 bp, Artificial Sequence
  Description of Artificial Sequence: Synthetic oligonucleotide
  Description of Combined DNA/RNA Molecule: Synthetic oligonucleotide
ucuggaaguccaucgacautt

SEQ ID NO: 820 - DNA, 21 bp, Artificial Sequence
  Description of Artificial Sequence: Synthetic oligonucleotide
  Description of Combined DNA/RNA Molecule: Synthetic oligonucleotide
ucgauggacuuccagaacctt

SEQ ID NO: 821 - DNA, 21 bp, Artificial Sequence
  Description of Artificial Sequence: Synthetic oligonucleotide
  Description of Combined DNA/RNA Molecule: Synthetic oligonucleotide
gguucuggaaguccaucgatt

SEQ ID NO: 822 - DNA, 21 bp, Artificial Sequence
  Description of Artificial Sequence: Synthetic oligonucleotide
  Description of Combined DNA/RNA Molecule: Synthetic oligonucleotide
gaaccaccugggcagcugctt

SEQ ID NO: 823 - DNA, 21 bp, Artificial Sequence
  Description of Artificial Sequence: Synthetic oligonucleotide
  Description of Combined DNA/RNA Molecule: Synthetic oligonucleotide
gcagcugcccaggugguuctt

SEQ ID NO: 824 - DNA, 21 bp, Artificial Sequence
  Description of Artificial Sequence: Synthetic oligonucleotide
  Description of Combined DNA/RNA Molecule: Synthetic oligonucleotide
gggcagcugccaaaagugutt

SEQ ID NO: 825 - DNA, 21 bp, Artificial Sequence
  Description of Artificial Sequence: Synthetic oligonucleotide
  Description of Combined DNA/RNA Molecule: Synthetic oligonucleotide
acacuuuuggcagcugccctt

SEQ ID NO: 826 - DNA, 21 bp, Artificial Sequence
  Description of Artificial Sequence: Synthetic oligonucleotide
  Description of Combined DNA/RNA Molecule: Synthetic oligonucleotide
gcagcugccaaaagugugatt

SEQ ID NO: 827 - DNA, 21 bp, Artificial Sequence
  Description of Artificial Sequence: Synthetic oligonucleotide
  Description of Combined DNA/RNA Molecule: Synthetic oligonucleotide
ucacacuuuuggcagcugctt

SEQ ID NO: 828 - DNA, 21 bp, Artificial Sequence
  Description of Artificial Sequence: Synthetic oligonucleotide
  Description of Combined DNA/RNA Molecule: Synthetic oligonucleotide
ugccaaaagugugauccaatt

SEQ ID NO: 829 - DNA, 21 bp, Artificial Sequence
  Description of Artificial Sequence: Synthetic oligonucleotide
  Description of Combined DNA/RNA Molecule: Synthetic oligonucleotide
uuggaucacacuuuuggcatt

SEQ ID NO: 830 - DNA, 21 bp, Artificial Sequence
  Description of Artificial Sequence: Synthetic oligonucleotide
  Description of Combined DNA/RNA Molecule: Synthetic oligonucleotide
gccaaaagugugauccaagtt

SEQ ID NO: 831 - DNA, 21 bp, Artificial Sequence
  Description of Artificial Sequence: Synthetic oligonucleotide
  Description of Combined DNA/RNA Molecule: Synthetic oligonucleotide
cuuggaucacacuuuuggctt

SEQ ID NO: 832 - DNA, 21 bp, Artificial Sequence
  Description of Artificial Sequence: Synthetic oligonucleotide
  Description of Combined DNA/RNA Molecule: Synthetic oligonucleotide
ccaaaagugugauccaagctt

SEQ ID NO: 833 - DNA, 21 bp, Artificial Sequence
  Description of Artificial Sequence: Synthetic oligonucleotide
  Description of Combined DNA/RNA Molecule: Synthetic oligonucleotide
gcuuggaucacacuuuuggtt

SEQ ID NO: 834 - DNA, 21 bp, Artificial Sequence
  Description of Artificial Sequence: Synthetic oligonucleotide
  Description of Combined DNA/RNA Molecule: Synthetic oligonucleotide
aaagugugauccaagcugutt

SEQ ID NO: 835 - DNA, 21 bp, Artificial Sequence
  Description of Artificial Sequence: Synthetic oligonucleotide
  Description of Combined DNA/RNA Molecule: Synthetic oligonucleotide
acagcuuggaucacacuuutt

SEQ ID NO: 836 - DNA, 21 bp, Artificial Sequence
  Description of Artificial Sequence: Synthetic oligonucleotide
  Description of Combined DNA/RNA Molecule: Synthetic oligonucleotide
ugugauccaagcugucccatt

SEQ ID NO: 837 - DNA, 21 bp, Artificial Sequence
  Description of Artificial Sequence: Synthetic oligonucleotide
  Description of Combined DNA/RNA Molecule: Synthetic oligonucleotide
ugggacagcuuggaucacatt

SEQ ID NO: 838 - DNA, 21 bp, Artificial Sequence
  Description of Artificial Sequence: Synthetic oligonucleotide
  Description of Combined DNA/RNA Molecule: Synthetic oligonucleotide
gugauccaagcugucccaatt

SEQ ID NO: 839 - DNA, 21 bp, Artificial Sequence
  Description of Artificial Sequence: Synthetic oligonucleotide
  Description of Combined DNA/RNA Molecule: Synthetic oligonucleotide
uugggacagcuuggaucactt

SEQ ID NO: 840 - DNA, 21 bp, Artificial Sequence
  Description of Artificial Sequence: Synthetic oligonucleotide
  Description of Combined DNA/RNA Molecule: Synthetic oligonucleotide
gauccaagcugucccaaugtt

SEQ ID NO: 841 - DNA, 21 bp, Artificial Sequence
  Description of Artificial Sequence: Synthetic oligonucleotide
  Description of Combined DNA/RNA Molecule: Synthetic oligonucleotide
cauugggacagcuuggauctt

SEQ ID NO: 842 - DNA, 21 bp, Artificial Sequence
  Description of Artificial Sequence: Synthetic oligonucleotide
  Description of Combined DNA/RNA Molecule: Synthetic oligonucleotide
auccaagcugucccaauggtt

SEQ ID NO: 843 - DNA, 21 bp, Artificial Sequence
  Description of Artificial Sequence: Synthetic oligonucleotide
  Description of Combined DNA/RNA Molecule: Synthetic oligonucleotide
ccauugggacagcuuggautt

SEQ ID NO: 844 - DNA, 21 bp, Artificial Sequence
  Description of Artificial Sequence: Synthetic oligonucleotide
  Description of Combined DNA/RNA Molecule: Synthetic oligonucleotide
uccaagcugucccaaugggtt

SEQ ID NO: 845 - DNA, 21 bp, Artificial Sequence
  Description of Artificial Sequence: Synthetic oligonucleotide
  Description of Combined DNA/RNA Molecule: Synthetic oligonucleotide
cccauugggacagcuuggatt

SEQ ID NO: 846 - DNA, 21 bp, Artificial Sequence
  Description of Artificial Sequence: Synthetic oligonucleotide
  Description of Combined DNA/RNA Molecule: Synthetic oligonucleotide
ccaagcugucccaaugggatt

SEQ ID NO: 847 - DNA, 21 bp, Artificial Sequence
  Description of Artificial Sequence: Synthetic oligonucleotide
  Description of Combined DNA/RNA Molecule: Synthetic oligonucleotide
ucccauugggacagcuuggtt

SEQ ID NO: 848 - DNA, 21 bp, Artificial Sequence
  Description of Artificial Sequence: Synthetic oligonucleotide
  Description of Combined DNA/RNA Molecule: Synthetic oligonucleotide
caagcugucccaaugggagtt

SEQ ID NO: 849 - DNA, 21 bp, Artificial Sequence
  Description of Artificial Sequence: Synthetic oligonucleotide
  Description of Combined DNA/RNA Molecule: Synthetic oligonucleotide
cucccauugggacagcuugtt

SEQ ID NO: 850 - DNA, 21 bp, Artificial Sequence
  Description of Artificial Sequence: Synthetic oligonucleotide
  Description of Combined DNA/RNA Molecule: Synthetic oligonucleotide
agcugucccaaugggagcutt

SEQ ID NO: 851 - DNA, 21 bp, Artificial Sequence
  Description of Artificial Sequence: Synthetic oligonucleotide
  Description of Combined DNA/RNA Molecule: Synthetic oligonucleotide
agcucccauugggacagcutt

SEQ ID NO: 852 - DNA, 21 bp, Artificial Sequence
  Description of Artificial Sequence: Synthetic oligonucleotide
  Description of Combined DNA/RNA Molecule: Synthetic oligonucleotide
ugucccaaugggagcugcutt

SEQ ID NO: 853 - DNA, 21 bp, Artificial Sequence
  Description of Artificial Sequence: Synthetic oligonucleotide
  Description of Combined DNA/RNA Molecule: Synthetic oligonucleotide
agcagcucccauugggacatt

SEQ ID NO: 854 - DNA, 21 bp, Artificial Sequence
  Description of Artificial Sequence: Synthetic oligonucleotide
  Description of Combined DNA/RNA Molecule: Synthetic oligonucleotide
ggugcaggagaggagaacutt

SEQ ID NO: 855 - DNA, 21 bp, Artificial Sequence
  Description of Artificial Sequence: Synthetic oligonucleotide
  Description of Combined DNA/RNA Molecule: Synthetic oligonucleotide
aguucuccucuccugcacctt

SEQ ID NO: 856 - DNA, 21 bp, Artificial Sequence
  Description of Artificial Sequence: Synthetic oligonucleotide
  Description of Combined DNA/RNA Molecule: Synthetic oligonucleotide
aaacugaccaaaaucaucutt

SEQ ID NO: 857 - DNA, 21 bp, Artificial Sequence
  Description of Artificial Sequence: Synthetic oligonucleotide
  Description of Combined DNA/RNA Molecule: Synthetic oligonucleotide
agaugauuuuggucaguuutt

SEQ ID NO: 858 - DNA, 21 bp, Artificial Sequence
  Description of Artificial Sequence: Synthetic oligonucleotide
  Description of Combined DNA/RNA Molecule: Synthetic oligonucleotide
aacugaccaaaaucaucugtt

SEQ ID NO: 859 - DNA, 21 bp, Artificial Sequence
  Description of Artificial Sequence: Synthetic oligonucleotide
  Description of Combined DNA/RNA Molecule: Synthetic oligonucleotide
cagaugauuuuggucaguutt

SEQ ID NO: 860 - DNA, 21 bp, Artificial Sequence
  Description of Artificial Sequence: Synthetic oligonucleotide
  Description of Combined DNA/RNA Molecule: Synthetic oligonucleotide
acugaccaaaaucaucugutt

SEQ ID NO: 861 - DNA, 21 bp, Artificial Sequence
  Description of Artificial Sequence: Synthetic oligonucleotide
  Description of Combined DNA/RNA Molecule: Synthetic oligonucleotide
acagaugauuuuggucagutt

SEQ ID NO: 862 - DNA, 21 bp, Artificial Sequence
  Description of Artificial Sequence: Synthetic oligonucleotide
  Description of Combined DNA/RNA Molecule: Synthetic oligonucleotide
accaaaaucaucugugccctt

SEQ ID NO: 863 - DNA, 21 bp, Artificial Sequence
  Description of Artificial Sequence: Synthetic oligonucleotide
  Description of Combined DNA/RNA Molecule: Synthetic oligonucleotide
gggcacagaugauuuuggutt

SEQ ID NO: 864 - DNA, 21 bp, Artificial Sequence
  Description of Artificial Sequence: Synthetic oligonucleotide
  Description of Combined DNA/RNA Molecule: Synthetic oligonucleotide
ccaaaaucaucugugcccatt

SEQ ID NO: 865 - DNA, 21 bp, Artificial Sequence
  Description of Artificial Sequence: Synthetic oligonucleotide
  Description of Combined DNA/RNA Molecule: Synthetic oligonucleotide
ugggcacagaugauuuuggtt

SEQ ID NO: 866 - DNA, 21 bp, Artificial Sequence
  Description of Artificial Sequence: Synthetic oligonucleotide
  Description of Combined DNA/RNA Molecule: Synthetic oligonucleotide
aaaucaucugugcccagcatt

SEQ ID NO: 867 - DNA, 21 bp, Artificial Sequence
  Description of Artificial Sequence: Synthetic oligonucleotide
  Description of Combined DNA/RNA Molecule: Synthetic oligonucleotide
ugcugggcacagaugauuutt

SEQ ID NO: 868 - DNA, 21 bp, Artificial Sequence
  Description of Artificial Sequence: Synthetic oligonucleotide
  Description of Combined DNA/RNA Molecule: Synthetic oligonucleotide
gugcccagcagugcuccggtt

SEQ ID NO: 869 - DNA, 21 bp, Artificial Sequence
  Description of Artificial Sequence: Synthetic oligonucleotide
  Description of Combined DNA/RNA Molecule: Synthetic oligonucleotide
ccggagcacugcugggcactt

SEQ ID NO: 870 - DNA, 21 bp, Artificial Sequence
  Description of Artificial Sequence: Synthetic oligonucleotide
  Description of Combined DNA/RNA Molecule: Synthetic oligonucleotide
gcccagcagugcuccgggctt

SEQ ID NO: 871 - DNA, 21 bp, Artificial Sequence
  Description of Artificial Sequence: Synthetic oligonucleotide
  Description of Combined DNA/RNA Molecule: Synthetic oligonucleotide
gcccggagcacugcugggctt

SEQ ID NO: 872 - DNA, 21 bp, Artificial Sequence
  Description of Artificial Sequence: Synthetic oligonucleotide
  Description of Combined DNA/RNA Molecule: Synthetic oligonucleotide
ccagugacugcugccacaatt

SEQ ID NO: 873 - DNA, 21 bp, Artificial Sequence
  Description of Artificial Sequence: Synthetic oligonucleotide
  Description of Combined DNA/RNA Molecule: Synthetic oligonucleotide
uuguggcagcagucacuggtt

SEQ ID NO: 874 - DNA, 21 bp, Artificial Sequence
  Description of Artificial Sequence: Synthetic oligonucleotide
  Description of Combined DNA/RNA Molecule: Synthetic oligonucleotide
cagugacugcugccacaactt

SEQ ID NO: 875 - DNA, 21 bp, Artificial Sequence
  Description of Artificial Sequence: Synthetic oligonucleotide
  Description of Combined DNA/RNA Molecule: Synthetic oligonucleotide
guuguggcagcagucacugtt

SEQ ID NO: 876 - DNA, 21 bp, Artificial Sequence
  Description of Artificial Sequence: Synthetic oligonucleotide
  Description of Combined DNA/RNA Molecule: Synthetic oligonucleotide
gagagcgacugccuggucutt

SEQ ID NO: 877 - DNA, 21 bp, Artificial Sequence
  Description of Artificial Sequence: Synthetic oligonucleotide
  Description of Combined DNA/RNA Molecule: Synthetic oligonucleotide
agaccaggcagucgcucuctt

SEQ ID NO: 878 - DNA, 21 bp, Artificial Sequence
  Description of Artificial Sequence: Synthetic oligonucleotide
  Description of Combined DNA/RNA Molecule: Synthetic oligonucleotide
agagcgacugccuggucugtt

SEQ ID NO: 879 - DNA, 21 bp, Artificial Sequence
  Description of Artificial Sequence: Synthetic oligonucleotide
  Description of Combined DNA/RNA Molecule: Synthetic oligonucleotide
cagaccaggcagucgcucutt

SEQ ID NO: 880 - DNA, 21 bp, Artificial Sequence
  Description of Artificial Sequence: Synthetic oligonucleotide
  Description of Combined DNA/RNA Molecule: Synthetic oligonucleotide
gagcgacugccuggucugctt

SEQ ID NO: 881 - DNA, 21 bp, Artificial Sequence
  Description of Artificial Sequence: Synthetic oligonucleotide
  Description of Combined DNA/RNA Molecule: Synthetic oligonucleotide
gcagaccaggcagucgcuctt

SEQ ID NO: 882 - DNA, 21 bp, Artificial Sequence
  Description of Artificial Sequence: Synthetic oligonucleotide
  Description of Combined DNA/RNA Molecule: Synthetic oligonucleotide
agcgacugccuggucugcctt

SEQ ID NO: 883 - DNA, 21 bp, Artificial Sequence
  Description of Artificial Sequence: Synthetic oligonucleotide
  Description of Combined DNA/RNA Molecule: Synthetic oligonucleotide
ggcagaccaggcagucgcutt

SEQ ID NO: 884 - DNA, 21 bp, Artificial Sequence
  Description of Artificial Sequence: Synthetic oligonucleotide
  Description of Combined DNA/RNA Molecule: Synthetic oligonucleotide
gcgacugccuggucugccgtt

SEQ ID NO: 885 - DNA, 21 bp, Artificial Sequence
  Description of Artificial Sequence: Synthetic oligonucleotide
  Description of Combined DNA/RNA Molecule: Synthetic oligonucleotide
cggcagaccaggcagucgctt

SEQ ID NO: 886 - DNA, 21 bp, Artificial Sequence
  Description of Artificial Sequence: Synthetic oligonucleotide
  Description of Combined DNA/RNA Molecule: Synthetic oligonucleotide
cgacugccuggucugccgctt

SEQ ID NO: 887 - DNA, 21 bp, Artificial Sequence
  Description of Artificial Sequence: Synthetic oligonucleotide
  Description of Combined DNA/RNA Molecule: Synthetic oligonucleotide
gcggcagaccaggcagucgtt

SEQ ID NO: 888 - DNA, 21 bp, Artificial Sequence
  Description of Artificial Sequence: Synthetic oligonucleotide
  Description of Combined DNA/RNA Molecule: Synthetic oligonucleotide
gccuggucugccgcaaauutt

SEQ ID NO: 889 - DNA, 21 bp, Artificial Sequence
  Description of Artificial Sequence: Synthetic oligonucleotide
  Description of Combined DNA/RNA Molecule: Synthetic oligonucleotide
aauuugcggcagaccaggctt

SEQ ID NO: 890 - DNA, 21 bp, Artificial Sequence
  Description of Artificial Sequence: Synthetic oligonucleotide
  Description of Combined DNA/RNA Molecule: Synthetic oligonucleotide
ccuggucugccgcaaauuctt

SEQ ID NO: 891 - DNA, 21 bp, Artificial Sequence
  Description of Artificial Sequence: Synthetic oligonucleotide
  Description of Combined DNA/RNA Molecule: Synthetic oligonucleotide
gaauuugcggcagaccaggtt

SEQ ID NO: 892 - DNA, 21 bp, Artificial Sequence
  Description of Artificial Sequence: Synthetic oligonucleotide
  Description of Combined DNA/RNA Molecule: Synthetic oligonucleotide
cuggucugccgcaaauucctt

SEQ ID NO: 893 - DNA, 21 bp, Artificial Sequence
  Description of Artificial Sequence: Synthetic oligonucleotide
  Description of Combined DNA/RNA Molecule: Synthetic oligonucleotide
ggaauuugcggcagaccagtt

SEQ ID NO: 894 - DNA, 21 bp, Artificial Sequence
  Description of Artificial Sequence: Synthetic oligonucleotide
  Description of Combined DNA/RNA Molecule: Synthetic oligonucleotide
uggucugccgcaaauuccgtt

SEQ ID NO: 895 - DNA, 21 bp, Artificial Sequence
  Description of Artificial Sequence: Synthetic oligonucleotide
  Description of Combined DNA/RNA Molecule: Synthetic oligonucleotide
cggaauuugcggcagaccatt

SEQ ID NO: 896 - DNA, 21 bp, Artificial Sequence
  Description of Artificial Sequence: Synthetic oligonucleotide
  Description of Combined DNA/RNA Molecule: Synthetic oligonucleotide
gucugccgcaaauuccgagtt

SEQ ID NO: 897 - DNA, 21 bp, Artificial Sequence
  Description of Artificial Sequence: Synthetic oligonucleotide
  Description of Combined DNA/RNA Molecule: Synthetic oligonucleotide
cucggaauuugcggcagactt

SEQ ID NO: 898 - DNA, 21 bp, Artificial Sequence
  Description of Artificial Sequence: Synthetic oligonucleotide
  Description of Combined DNA/RNA Molecule: Synthetic oligonucleotide
ucugccgcaaauuccgagatt

SEQ ID NO: 899 - DNA, 21 bp, Artificial Sequence
  Description of Artificial Sequence: Synthetic oligonucleotide
  Description of Combined DNA/RNA Molecule: Synthetic oligonucleotide
ucucggaauuugcggcagatt

SEQ ID NO: 900 - DNA, 21 bp, Artificial Sequence
  Description of Artificial Sequence: Synthetic oligonucleotide
  Description of Combined DNA/RNA Molecule: Synthetic oligonucleotide
cugccgcaaauuccgagactt

SEQ ID NO: 901 - DNA, 21 bp, Artificial Sequence
  Description of Artificial Sequence: Synthetic oligonucleotide
  Description of Combined DNA/RNA Molecule: Synthetic oligonucleotide
gucucggaauuugcggcagtt

SEQ ID NO: 902 - DNA, 21 bp, Artificial Sequence
  Description of Artificial Sequence: Synthetic oligonucleotide
  Description of Combined DNA/RNA Molecule: Synthetic oligonucleotide
ugccgcaaauuccgagacgtt

SEQ ID NO: 903 - DNA, 21 bp, Artificial Sequence
  Description of Artificial Sequence: Synthetic oligonucleotide
  Description of Combined DNA/RNA Molecule: Synthetic oligonucleotide
cgucucggaauuugcggcatt

SEQ ID NO: 904 - DNA, 21 bp, Artificial Sequence
  Description of Artificial Sequence: Synthetic oligonucleotide
  Description of Combined DNA/RNA Molecule: Synthetic oligonucleotide
ccgcaaauuccgagacgaatt

SEQ ID NO: 905 - DNA, 21 bp, Artificial Sequence
  Description of Artificial Sequence: Synthetic oligonucleotide
  Description of Combined DNA/RNA Molecule: Synthetic oligonucleotide
uucgucucggaauuugcggtt

SEQ ID NO: 906 - DNA, 21 bp, Artificial Sequence
  Description of Artificial Sequence: Synthetic oligonucleotide
  Description of Combined DNA/RNA Molecule: Synthetic oligonucleotide
aauuccgagacgaagccactt

SEQ ID NO: 907 - DNA, 21 bp, Artificial Sequence
  Description of Artificial Sequence: Synthetic oligonucleotide
  Description of Combined DNA/RNA Molecule: Synthetic oligonucleotide
guggcuucgucucggaauutt

SEQ ID NO: 908 - DNA, 21 bp, Artificial Sequence
  Description of Artificial Sequence: Synthetic oligonucleotide
  Description of Combined DNA/RNA Molecule: Synthetic oligonucleotide
auuccgagacgaagccacgtt

SEQ ID NO: 909 - DNA, 21 bp, Artificial Sequence
  Description of Artificial Sequence: Synthetic oligonucleotide
  Description of Combined DNA/RNA Molecule: Synthetic oligonucleotide
cguggcuucgucucggaautt

SEQ ID NO: 910 - DNA, 21 bp, Artificial Sequence
  Description of Artificial Sequence: Synthetic oligonucleotide
  Description of Combined DNA/RNA Molecule: Synthetic oligonucleotide
uuccgagacgaagccacgutt

SEQ ID NO: 911 - DNA, 21 bp, Artificial Sequence
  Description of Artificial Sequence: Synthetic oligonucleotide
  Description of Combined DNA/RNA Molecule: Synthetic oligonucleotide
acguggcuucgucucggaatt

SEQ ID NO: 912 - DNA, 21 bp, Artificial Sequence
  Description of Artificial Sequence: Synthetic oligonucleotide
  Description of Combined DNA/RNA Molecule: Synthetic oligonucleotide
uccgagacgaagccacgugtt

SEQ ID NO: 913 - DNA, 21 bp, Artificial Sequence
  Description of Artificial Sequence: Synthetic oligonucleotide
  Description of Combined DNA/RNA Molecule: Synthetic oligonucleotide
cacguggcuucgucucggatt

SEQ ID NO: 914 - DNA, 21 bp, Artificial Sequence
  Description of Artificial Sequence: Synthetic oligonucleotide
  Description of Combined DNA/RNA Molecule: Synthetic oligonucleotide
ccgagacgaagccacgugctt

SEQ ID NO: 915 - DNA, 21 bp, Artificial Sequence
  Description of Artificial Sequence: Synthetic oligonucleotide
  Description of Combined DNA/RNA Molecule: Synthetic oligonucleotide
gcacguggcuucgucucggtt

SEQ ID NO: 916 - DNA, 21 bp, Artificial Sequence
  Description of Artificial Sequence: Synthetic oligonucleotide
  Description of Combined DNA/RNA Molecule: Synthetic oligonucleotide
gagacgaagccacgugcaatt

SEQ ID NO: 917 - DNA, 21 bp, Artificial Sequence
  Description of Artificial Sequence: Synthetic oligonucleotide
  Description of Combined DNA/RNA Molecule: Synthetic oligonucleotide
uugcacguggcuucgucuctt

SEQ ID NO: 918 - DNA, 21 bp, Artificial Sequence
  Description of Artificial Sequence: Synthetic oligonucleotide
  Description of Combined DNA/RNA Molecule: Synthetic oligonucleotide
acgaagccacgugcaaggatt

SEQ ID NO: 919 - DNA, 21 bp, Artificial Sequence
  Description of Artificial Sequence: Synthetic oligonucleotide
  Description of Combined DNA/RNA Molecule: Synthetic oligonucleotide
uccuugcacguggcuucgutt

SEQ ID NO: 920 - DNA, 21 bp, Artificial Sequence
  Description of Artificial Sequence: Synthetic oligonucleotide
  Description of Combined DNA/RNA Molecule: Synthetic oligonucleotide
cgaagccacgugcaaggactt

SEQ ID NO: 921 - DNA, 21 bp, Artificial Sequence
  Description of Artificial Sequence: Synthetic oligonucleotide
  Description of Combined DNA/RNA Molecule: Synthetic oligonucleotide
guccuugcacguggcuucgtt

SEQ ID NO: 922 - DNA, 21 bp, Artificial Sequence
  Description of Artificial Sequence: Synthetic oligonucleotide
  Description of Combined DNA/RNA Molecule: Synthetic oligonucleotide
gaagccacgugcaaggacatt

SEQ ID NO: 923 - DNA, 21 bp, Artificial Sequence
  Description of Artificial Sequence: Synthetic oligonucleotide
  Description of Combined DNA/RNA Molecule: Synthetic oligonucleotide
uguccuugcacguggcuuctt

SEQ ID NO: 924 - DNA, 21 bp, Artificial Sequence
  Description of Artificial Sequence: Synthetic oligonucleotide
  Description of Combined DNA/RNA Molecule: Synthetic oligonucleotide
aagccacgugcaaggacactt

SEQ ID NO: 925 - DNA, 21 bp, Artificial Sequence
  Description of Artificial Sequence: Synthetic oligonucleotide
  Description of Combined DNA/RNA Molecule: Synthetic oligonucleotide
guguccuugcacguggcuutt

SEQ ID NO: 926 - DNA, 21 bp, Artificial Sequence
  Description of Artificial Sequence: Synthetic oligonucleotide
  Description of Combined DNA/RNA Molecule: Synthetic oligonucleotide
ccccacucaugcucuacaatt

SEQ ID NO: 927 - DNA, 21 bp, Artificial Sequence
  Description of Artificial Sequence: Synthetic oligonucleotide
  Description of Combined DNA/RNA Molecule: Synthetic oligonucleotide
uuguagagcaugaguggggtt

SEQ ID NO: 928 - DNA, 21 bp, Artificial Sequence
  Description of Artificial Sequence: Synthetic oligonucleotide
  Description of Combined DNA/RNA Molecule: Synthetic oligonucleotide
ccacucaugcucuacaacctt

SEQ ID NO: 929 - DNA, 21 bp, Artificial Sequence
  Description of Artificial Sequence: Synthetic oligonucleotide
  Description of Combined DNA/RNA Molecule: Synthetic oligonucleotide
gguuguagagcaugaguggtt

SEQ ID NO: 930 - DNA, 21 bp, Artificial Sequence
  Description of Artificial Sequence: Synthetic oligonucleotide
  Description of Combined DNA/RNA Molecule: Synthetic oligonucleotide
acucaugcucuacaacccctt

SEQ ID NO: 931 - DNA, 21 bp, Artificial Sequence
  Description of Artificial Sequence: Synthetic oligonucleotide
  Description of Combined DNA/RNA Molecule: Synthetic oligonucleotide
gggguuguagagcaugagutt

SEQ ID NO: 932 - DNA, 21 bp, Artificial Sequence
  Description of Artificial Sequence: Synthetic oligonucleotide
  Description of Combined DNA/RNA Molecule: Synthetic oligonucleotide
caugcucuacaaccccacctt

SEQ ID NO: 933 - DNA, 21 bp, Artificial Sequence
  Description of Artificial Sequence: Synthetic oligonucleotide
  Description of Combined DNA/RNA Molecule: Synthetic oligonucleotide
ggugggguuguagagcaugtt

SEQ ID NO: 934 - DNA, 21 bp, Artificial Sequence
  Description of Artificial Sequence: Synthetic oligonucleotide
  Description of Combined DNA/RNA Molecule: Synthetic oligonucleotide
ccagauggaugugaacccctt

SEQ ID NO: 935 - DNA, 21 bp, Artificial Sequence
  Description of Artificial Sequence: Synthetic oligonucleotide
  Description of Combined DNA/RNA Molecule: Synthetic oligonucleotide
gggguucacauccaucuggtt

SEQ ID NO: 936 - DNA, 21 bp, Artificial Sequence
  Description of Artificial Sequence: Synthetic oligonucleotide
  Description of Combined DNA/RNA Molecule: Synthetic oligonucleotide
agauggaugugaaccccgatt

SEQ ID NO: 937 - DNA, 21 bp, Artificial Sequence
  Description of Artificial Sequence: Synthetic oligonucleotide
  Description of Combined DNA/RNA Molecule: Synthetic oligonucleotide
ucgggguucacauccaucutt

SEQ ID NO: 938 - DNA, 21 bp, Artificial Sequence
  Description of Artificial Sequence: Synthetic oligonucleotide
  Description of Combined DNA/RNA Molecule: Synthetic oligonucleotide
gauggaugugaaccccgagtt

SEQ ID NO: 939 - DNA, 21 bp, Artificial Sequence
  Description of Artificial Sequence: Synthetic oligonucleotide
  Description of Combined DNA/RNA Molecule: Synthetic oligonucleotide
cucgggguucacauccauctt

SEQ ID NO: 940 - DNA, 21 bp, Artificial Sequence
  Description of Artificial Sequence: Synthetic oligonucleotide
  Description of Combined DNA/RNA Molecule: Synthetic oligonucleotide
auggaugugaaccccgaggtt

SEQ ID NO: 941 - DNA, 21 bp, Artificial Sequence
  Description of Artificial Sequence: Synthetic oligonucleotide
  Description of Combined DNA/RNA Molecule: Synthetic oligonucleotide
ccucgggguucacauccautt

SEQ ID NO: 942 - DNA, 21 bp, Artificial Sequence
  Description of Artificial Sequence: Synthetic oligonucleotide
  Description of Combined DNA/RNA Molecule: Synthetic oligonucleotide
ggaugugaaccccgagggctt

SEQ ID NO: 943 - DNA, 21 bp, Artificial Sequence
  Description of Artificial Sequence: Synthetic oligonucleotide
  Description of Combined DNA/RNA Molecule: Synthetic oligonucleotide
gcccucgggguucacaucctt

SEQ ID NO: 944 - DNA, 21 bp, Artificial Sequence
  Description of Artificial Sequence: Synthetic oligonucleotide
  Description of Combined DNA/RNA Molecule: Synthetic oligonucleotide
gaugugaaccccgagggcatt

SEQ ID NO: 945 - DNA, 21 bp, Artificial Sequence
  Description of Artificial Sequence: Synthetic oligonucleotide
  Description of Combined DNA/RNA Molecule: Synthetic oligonucleotide
ugcccucgggguucacauctt

SEQ ID NO: 946 - DNA, 21 bp, Artificial Sequence
  Description of Artificial Sequence: Synthetic oligonucleotide
  Description of Combined DNA/RNA Molecule: Synthetic oligonucleotide
ugugaaccccgagggcaaatt

SEQ ID NO: 947 - DNA, 21 bp, Artificial Sequence
  Description of Artificial Sequence: Synthetic oligonucleotide
  Description of Combined DNA/RNA Molecule: Synthetic oligonucleotide
uuugcccucgggguucacatt

SEQ ID NO: 948 - DNA, 21 bp, Artificial Sequence
  Description of Artificial Sequence: Synthetic oligonucleotide
  Description of Combined DNA/RNA Molecule: Synthetic oligonucleotide
aaccccgagggcaaauacatt

SEQ ID NO: 949 - DNA, 21 bp, Artificial Sequence
  Description of Artificial Sequence: Synthetic oligonucleotide
  Description of Combined DNA/RNA Molecule: Synthetic oligonucleotide
uguauuugcccucgggguutt

SEQ ID NO: 950 - DNA, 21 bp, Artificial Sequence
  Description of Artificial Sequence: Synthetic oligonucleotide
  Description of Combined DNA/RNA Molecule: Synthetic oligonucleotide
accccgagggcaaauacagtt

SEQ ID NO: 951 - DNA, 21 bp, Artificial Sequence
  Description of Artificial Sequence: Synthetic oligonucleotide
  Description of Combined DNA/RNA Molecule: Synthetic oligonucleotide
cuguauuugcccucggggutt

SEQ ID NO: 952 - DNA, 21 bp, Artificial Sequence
  Description of Artificial Sequence: Synthetic oligonucleotide
  Description of Combined DNA/RNA Molecule: Synthetic oligonucleotide
cccgagggcaaauacagcutt

SEQ ID NO: 953 - DNA, 21 bp, Artificial Sequence
  Description of Artificial Sequence: Synthetic oligonucleotide
  Description of Combined DNA/RNA Molecule: Synthetic oligonucleotide
agcuguauuugcccucgggtt

SEQ ID NO: 954 - DNA, 21 bp, Artificial Sequence
  Description of Artificial Sequence: Synthetic oligonucleotide
  Description of Combined DNA/RNA Molecule: Synthetic oligonucleotide
ccgagggcaaauacagcuutt

SEQ ID NO: 955 - DNA, 21 bp, Artificial Sequence
  Description of Artificial Sequence: Synthetic oligonucleotide
  Description of Combined DNA/RNA Molecule: Synthetic oligonucleotide
aagcuguauuugcccucggtt

SEQ ID NO: 956 - DNA, 21 bp, Artificial Sequence
  Description of Artificial Sequence: Synthetic oligonucleotide
  Description of Combined DNA/RNA Molecule: Synthetic oligonucleotide
cgagggcaaauacagcuuutt

SEQ ID NO: 957 - DNA, 21 bp, Artificial Sequence
  Description of Artificial Sequence: Synthetic oligonucleotide
  Description of Combined DNA/RNA Molecule: Synthetic oligonucleotide
aaagcuguauuugcccucgtt

SEQ ID NO: 958 - DNA, 21 bp, Artificial Sequence
  Description of Artificial Sequence: Synthetic oligonucleotide
  Description of Combined DNA/RNA Molecule: Synthetic oligonucleotide
aaauacagcuuuggugccatt

SEQ ID NO: 959 - DNA, 21 bp, Artificial Sequence
  Description of Artificial Sequence: Synthetic oligonucleotide
  Description of Combined DNA/RNA Molecule: Synthetic oligonucleotide
uggcaccaaagcuguauuutt

SEQ ID NO: 960 - DNA, 21 bp, Artificial Sequence
  Description of Artificial Sequence: Synthetic oligonucleotide
  Description of Combined DNA/RNA Molecule: Synthetic oligonucleotide
aauacagcuuuggugccactt

SEQ ID NO: 961 - DNA, 21 bp, Artificial Sequence
  Description of Artificial Sequence: Synthetic oligonucleotide
  Description of Combined DNA/RNA Molecule: Synthetic oligonucleotide
guggcaccaaagcuguauutt

SEQ ID NO: 962 - DNA, 21 bp, Artificial Sequence
  Description of Artificial Sequence: Synthetic oligonucleotide
  Description of Combined DNA/RNA Molecule: Synthetic oligonucleotide
auacagcuuuggugccacctt

SEQ ID NO: 963 - DNA, 21 bp, Artificial Sequence
  Description of Artificial Sequence: Synthetic oligonucleotide
  Description of Combined DNA/RNA Molecule: Synthetic oligonucleotide
gguggcaccaaagcuguautt

SEQ ID NO: 964 - DNA, 21 bp, Artificial Sequence
  Description of Artificial Sequence: Synthetic oligonucleotide
  Description of Combined DNA/RNA Molecule: Synthetic oligonucleotide
cuuuggugccaccugcgugtt

SEQ ID NO: 965 - DNA, 21 bp, Artificial Sequence
  Description of Artificial Sequence: Synthetic oligonucleotide
  Description of Combined DNA/RNA Molecule: Synthetic oligonucleotide
cacgcagguggcaccaaagtt

SEQ ID NO: 966 - DNA, 21 bp, Artificial Sequence
  Description of Artificial Sequence: Synthetic oligonucleotide
  Description of Combined DNA/RNA Molecule: Synthetic oligonucleotide
uuggugccaccugcgugaatt

SEQ ID NO: 967 - DNA, 21 bp, Artificial Sequence
  Description of Artificial Sequence: Synthetic oligonucleotide
  Description of Combined DNA/RNA Molecule: Synthetic oligonucleotide
uucacgcagguggcaccaatt

SEQ ID NO: 968 - DNA, 21 bp, Artificial Sequence
  Description of Artificial Sequence: Synthetic oligonucleotide
  Description of Combined DNA/RNA Molecule: Synthetic oligonucleotide
ccaccugcgugaagaagugtt

SEQ ID NO: 969 - DNA, 21 bp, Artificial Sequence
  Description of Artificial Sequence: Synthetic oligonucleotide
  Description of Combined DNA/RNA Molecule: Synthetic oligonucleotide
cacuucuucacgcagguggtt

SEQ ID NO: 970 - DNA, 21 bp, Artificial Sequence
  Description of Artificial Sequence: Synthetic oligonucleotide
  Description of Combined DNA/RNA Molecule: Synthetic oligonucleotide
cugcgugaagaaguguccctt

SEQ ID NO: 971 - DNA, 21 bp, Artificial Sequence
  Description of Artificial Sequence: Synthetic oligonucleotide
  Description of Combined DNA/RNA Molecule: Synthetic oligonucleotide
gggacacuucuucacgcagtt

SEQ ID NO: 972 - DNA, 21 bp, Artificial Sequence
  Description of Artificial Sequence: Synthetic oligonucleotide
  Description of Combined DNA/RNA Molecule: Synthetic oligonucleotide
ugcgugaagaagugucccctt

SEQ ID NO: 973 - DNA, 21 bp, Artificial Sequence
  Description of Artificial Sequence: Synthetic oligonucleotide
  Description of Combined DNA/RNA Molecule: Synthetic oligonucleotide
ggggacacuucuucacgcatt

SEQ ID NO: 974 - DNA, 21 bp, Artificial Sequence
  Description of Artificial Sequence: Synthetic oligonucleotide
  Description of Combined DNA/RNA Molecule: Synthetic oligonucleotide
gcgugaagaaguguccccgtt

SEQ ID NO: 975 - DNA, 21 bp, Artificial Sequence
  Description of Artificial Sequence: Synthetic oligonucleotide
  Description of Combined DNA/RNA Molecule: Synthetic oligonucleotide
cggggacacuucuucacgctt

SEQ ID NO: 976 - DNA, 21 bp, Artificial Sequence
  Description of Artificial Sequence: Synthetic oligonucleotide
  Description of Combined DNA/RNA Molecule: Synthetic oligonucleotide
cgugaagaaguguccccgutt

SEQ ID NO: 977 - DNA, 21 bp, Artificial Sequence
  Description of Artificial Sequence: Synthetic oligonucleotide
  Description of Combined DNA/RNA Molecule: Synthetic oligonucleotide
acggggacacuucuucacgtt

SEQ ID NO: 978 - DNA, 21 bp, Artificial Sequence
  Description of Artificial Sequence: Synthetic oligonucleotide
  Description of Combined DNA/RNA Molecule: Synthetic oligonucleotide
gugaagaaguguccccguatt

SEQ ID NO: 979 - DNA, 21 bp, Artificial Sequence
  Description of Artificial Sequence: Synthetic oligonucleotide
  Description of Combined DNA/RNA Molecule: Synthetic oligonucleotide
uacggggacacuucuucactt

SEQ ID NO: 980 - DNA, 21 bp, Artificial Sequence
  Description of Artificial Sequence: Synthetic oligonucleotide
  Description of Combined DNA/RNA Molecule: Synthetic oligonucleotide
ugaagaaguguccccguaatt

SEQ ID NO: 981 - DNA, 21 bp, Artificial Sequence
  Description of Artificial Sequence: Synthetic oligonucleotide
  Description of Combined DNA/RNA Molecule: Synthetic oligonucleotide
uuacggggacacuucuucatt

SEQ ID NO: 982 - DNA, 21 bp, Artificial Sequence
  Description of Artificial Sequence: Synthetic oligonucleotide
  Description of Combined DNA/RNA Molecule: Synthetic oligonucleotide
gaagaaguguccccguaautt

SEQ ID NO: 983 - DNA, 21 bp, Artificial Sequence
  Description of Artificial Sequence: Synthetic oligonucleotide
  Description of Combined DNA/RNA Molecule: Synthetic oligonucleotide
auuacggggacacuucuuctt

SEQ ID NO: 984 - DNA, 21 bp, Artificial Sequence
  Description of Artificial Sequence: Synthetic oligonucleotide
  Description of Combined DNA/RNA Molecule: Synthetic oligonucleotide
aagaaguguccccguaauutt

SEQ ID NO: 985 - DNA, 21 bp, Artificial Sequence
  Description of Artificial Sequence: Synthetic oligonucleotide
  Description of Combined DNA/RNA Molecule: Synthetic oligonucleotide
aauuacggggacacuucuutt

SEQ ID NO: 986 - DNA, 21 bp, Artificial Sequence
  Description of Artificial Sequence: Synthetic oligonucleotide
  Description of Combined DNA/RNA Molecule: Synthetic oligonucleotide
agaaguguccccguaauuatt

SEQ ID NO: 987 - DNA, 21 bp, Artificial Sequence
  Description of Artificial Sequence: Synthetic oligonucleotide
  Description of Combined DNA/RNA Molecule: Synthetic oligonucleotide
uaauuacggggacacuucutt

SEQ ID NO: 988 - DNA, 21 bp, Artificial Sequence
  Description of Artificial Sequence: Synthetic oligonucleotide
  Description of Combined DNA/RNA Molecule: Synthetic oligonucleotide
gaaguguccccguaauuautt

SEQ ID NO: 989 - DNA, 21 bp, Artificial Sequence
  Description of Artificial Sequence: Synthetic oligonucleotide
  Description of Combined DNA/RNA Molecule: Synthetic oligonucleotide
auaauuacggggacacuuctt

SEQ ID NO: 990 - DNA, 21 bp, Artificial Sequence
  Description of Artificial Sequence: Synthetic oligonucleotide
  Description of Combined DNA/RNA Molecule: Synthetic oligonucleotide
aaguguccccguaauuaugtt

SEQ ID NO: 991 - DNA, 21 bp, Artificial Sequence
  Description of Artificial Sequence: Synthetic oligonucleotide
  Description of Combined DNA/RNA Molecule: Synthetic oligonucleotide
cauaauuacggggacacuutt

SEQ ID NO: 992 - DNA, 21 bp, Artificial Sequence
  Description of Artificial Sequence: Synthetic oligonucleotide
  Description of Combined DNA/RNA Molecule: Synthetic oligonucleotide
aguguccccguaauuaugutt

SEQ ID NO: 993 - DNA, 21 bp, Artificial Sequence
  Description of Artificial Sequence: Synthetic oligonucleotide
  Description of Combined DNA/RNA Molecule: Synthetic oligonucleotide
acauaauuacggggacacutt

SEQ ID NO: 994 - DNA, 21 bp, Artificial Sequence
  Description of Artificial Sequence: Synthetic oligonucleotide
  Description of Combined DNA/RNA Molecule: Synthetic oligonucleotide
guguccccguaauuaugugtt

SEQ ID NO: 995 - DNA, 21 bp, Artificial Sequence
  Description of Artificial Sequence: Synthetic oligonucleotide
  Description of Combined DNA/RNA Molecule: Synthetic oligonucleotide
cacauaauuacggggacactt

SEQ ID NO: 996 - DNA, 21 bp, Artificial Sequence
  Description of Artificial Sequence: Synthetic oligonucleotide
  Description of Combined DNA/RNA Molecule: Synthetic oligonucleotide
uguccccguaauuauguggtt

SEQ ID NO: 997 - DNA, 21 bp, Artificial Sequence
  Description of Artificial Sequence: Synthetic oligonucleotide
  Description of Combined DNA/RNA Molecule: Synthetic oligonucleotide
ccacauaauuacggggacatt

SEQ ID NO: 998 - DNA, 21 bp, Artificial Sequence
  Description of Artificial Sequence: Synthetic oligonucleotide
  Description of Combined DNA/RNA Molecule: Synthetic oligonucleotide
guccccguaauuauguggutt

SEQ ID NO: 999 - DNA, 21 bp, Artificial Sequence
  Description of Artificial Sequence: Synthetic oligonucleotide
  Description of Combined DNA/RNA Molecule: Synthetic oligonucleotide
accacauaauuacggggactt

SEQ ID NO: 1000 - DNA, 21 bp, Artificial Sequence
  Description of Artificial Sequence: Synthetic oligonucleotide
  Description of Combined DNA/RNA Molecule: Synthetic oligonucleotide
ccccguaauuauguggugatt

SEQ ID NO: 1001 - DNA, 21 bp, Artificial Sequence
  Description of Artificial Sequence: Synthetic oligonucleotide
  Description of Combined DNA/RNA Molecule: Synthetic oligonucleotide
ucaccacauaauuacggggtt

SEQ ID NO: 1002 - DNA, 21 bp, Artificial Sequence
  Description of Artificial Sequence: Synthetic oligonucleotide
  Description of Combined DNA/RNA Molecule: Synthetic oligonucleotide
ccguaauuauguggugacatt

SEQ ID NO: 1003 - DNA, 21 bp, Artificial Sequence
  Description of Artificial Sequence: Synthetic oligonucleotide
  Description of Combined DNA/RNA Molecule: Synthetic oligonucleotide
ugucaccacauaauuacggtt

SEQ ID NO: 1004 - DNA, 21 bp, Artificial Sequence
  Description of Artificial Sequence: Synthetic oligonucleotide
  Description of Combined DNA/RNA Molecule: Synthetic oligonucleotide
guaauuauguggugacagatt

SEQ ID NO: 1005 - DNA, 21 bp, Artificial Sequence
  Description of Artificial Sequence: Synthetic oligonucleotide
  Description of Combined DNA/RNA Molecule: Synthetic oligonucleotide
ucugucaccacauaauuactt

SEQ ID NO: 1006 - DNA, 21 bp, Artificial Sequence
  Description of Artificial Sequence: Synthetic oligonucleotide
  Description of Combined DNA/RNA Molecule: Synthetic oligonucleotide
uaauuauguggugacagautt

SEQ ID NO: 1007 - DNA, 21 bp, Artificial Sequence
  Description of Artificial Sequence: Synthetic oligonucleotide
  Description of Combined DNA/RNA Molecule: Synthetic oligonucleotide
aucugucaccacauaauuatt

SEQ ID NO: 1008 - DNA, 21 bp, Artificial Sequence
  Description of Artificial Sequence: Synthetic oligonucleotide
  Description of Combined DNA/RNA Molecule: Synthetic oligonucleotide
aauuauguggugacagauctt

SEQ ID NO: 1009 - DNA, 21 bp, Artificial Sequence
  Description of Artificial Sequence: Synthetic oligonucleotide
  Description of Combined DNA/RNA Molecule: Synthetic oligonucleotide
gaucugucaccacauaauutt

SEQ ID NO: 1010 - DNA, 21 bp, Artificial Sequence
  Description of Artificial Sequence: Synthetic oligonucleotide
  Description of Combined DNA/RNA Molecule: Synthetic oligonucleotide
auuauguggugacagaucatt

SEQ ID NO: 1011 - DNA, 21 bp, Artificial Sequence
  Description of Artificial Sequence: Synthetic oligonucleotide
  Description of Combined DNA/RNA Molecule: Synthetic oligonucleotide
ugaucugucaccacauaautt

SEQ ID NO: 1012 - DNA, 21 bp, Artificial Sequence
  Description of Artificial Sequence: Synthetic oligonucleotide
  Description of Combined DNA/RNA Molecule: Synthetic oligonucleotide
uuauguggugacagaucactt

SEQ ID NO: 1013 - DNA, 21 bp, Artificial Sequence
  Description of Artificial Sequence: Synthetic oligonucleotide
  Description of Combined DNA/RNA Molecule: Synthetic oligonucleotide
gugaucugucaccacauaatt

SEQ ID NO: 1014 - DNA, 21 bp, Artificial Sequence
  Description of Artificial Sequence: Synthetic oligonucleotide
  Description of Combined DNA/RNA Molecule: Synthetic oligonucleotide
auguggugacagaucacggtt

SEQ ID NO: 1015 - DNA, 21 bp, Artificial Sequence
  Description of Artificial Sequence: Synthetic oligonucleotide
  Description of Combined DNA/RNA Molecule: Synthetic oligonucleotide
ccgugaucugucaccacautt

SEQ ID NO: 1016 - DNA, 21 bp, Artificial Sequence
  Description of Artificial Sequence: Synthetic oligonucleotide
  Description of Combined DNA/RNA Molecule: Synthetic oligonucleotide
uggugacagaucacggcuctt

SEQ ID NO: 1017 - DNA, 21 bp, Artificial Sequence
  Description of Artificial Sequence: Synthetic oligonucleotide
  Description of Combined DNA/RNA Molecule: Synthetic oligonucleotide
gagccgugaucugucaccatt

SEQ ID NO: 1018 - DNA, 21 bp, Artificial Sequence
  Description of Artificial Sequence: Synthetic oligonucleotide
  Description of Combined DNA/RNA Molecule: Synthetic oligonucleotide
gugacagaucacggcucgutt

SEQ ID NO: 1019 - DNA, 21 bp, Artificial Sequence
  Description of Artificial Sequence: Synthetic oligonucleotide
  Description of Combined DNA/RNA Molecule: Synthetic oligonucleotide
acgagccgugaucugucactt

SEQ ID NO: 1020 - DNA, 21 bp, Artificial Sequence
  Description of Artificial Sequence: Synthetic oligonucleotide
  Description of Combined DNA/RNA Molecule: Synthetic oligonucleotide
ugacagaucacggcucgugtt

SEQ ID NO: 1021 - DNA, 21 bp, Artificial Sequence
  Description of Artificial Sequence: Synthetic oligonucleotide
  Description of Combined DNA/RNA Molecule: Synthetic oligonucleotide
cacgagccgugaucugucatt

SEQ ID NO: 1022 - DNA, 21 bp, Artificial Sequence
  Description of Artificial Sequence: Synthetic oligonucleotide
  Description of Combined DNA/RNA Molecule: Synthetic oligonucleotide
gacagaucacggcucgugctt

SEQ ID NO: 1023 - DNA, 21 bp, Artificial Sequence
  Description of Artificial Sequence: Synthetic oligonucleotide
  Description of Combined DNA/RNA Molecule: Synthetic oligonucleotide
gcacgagccgugaucuguctt

SEQ ID NO: 1024 - DNA, 21 bp, Artificial Sequence
  Description of Artificial Sequence: Synthetic oligonucleotide
  Description of Combined DNA/RNA Molecule: Synthetic oligonucleotide
acagaucacggcucgugcgtt

SEQ ID NO: 1025 - DNA, 21 bp, Artificial Sequence
  Description of Artificial Sequence: Synthetic oligonucleotide
  Description of Combined DNA/RNA Molecule: Synthetic oligonucleotide
cgcacgagccgugaucugutt

SEQ ID NO: 1026 - DNA, 21 bp, Artificial Sequence
  Description of Artificial Sequence: Synthetic oligonucleotide
  Description of Combined DNA/RNA Molecule: Synthetic oligonucleotide
cagaucacggcucgugcgutt

SEQ ID NO: 1027 - DNA, 21 bp, Artificial Sequence
  Description of Artificial Sequence: Synthetic oligonucleotide
  Description of Combined DNA/RNA Molecule: Synthetic oligonucleotide
acgcacgagccgugaucugtt

SEQ ID NO: 1028 - DNA, 21 bp, Artificial Sequence
  Description of Artificial Sequence: Synthetic oligonucleotide
  Description of Combined DNA/RNA Molecule: Synthetic oligonucleotide
agaucacggcucgugcguctt

SEQ ID NO: 1029 - DNA, 21 bp, Artificial Sequence
  Description of Artificial Sequence: Synthetic oligonucleotide
  Description of Combined DNA/RNA Molecule: Synthetic oligonucleotide
gacgcacgagccgugaucutt

SEQ ID NO: 1030 - DNA, 21 bp, Artificial Sequence
  Description of Artificial Sequence: Synthetic oligonucleotide
  Description of Combined DNA/RNA Molecule: Synthetic oligonucleotide
gaucacggcucgugcgucctt

SEQ ID NO: 1031 - DNA, 21 bp, Artificial Sequence
  Description of Artificial Sequence: Synthetic oligonucleotide
  Description of Combined DNA/RNA Molecule: Synthetic oligonucleotide
ggacgcacgagccgugauctt

SEQ ID NO: 1032 - DNA, 21 bp, Artificial Sequence
  Description of Artificial Sequence: Synthetic oligonucleotide
  Description of Combined DNA/RNA Molecule: Synthetic oligonucleotide
aucacggcucgugcguccgtt

SEQ ID NO: 1033 - DNA, 21 bp, Artificial Sequence
  Description of Artificial Sequence: Synthetic oligonucleotide
  Description of Combined DNA/RNA Molecule: Synthetic oligonucleotide
cggacgcacgagccgugautt

SEQ ID NO: 1034 - DNA, 21 bp, Artificial Sequence
  Description of Artificial Sequence: Synthetic oligonucleotide
  Description of Combined DNA/RNA Molecule: Synthetic oligonucleotide
ucacggcucgugcguccgatt

SEQ ID NO: 1035 - DNA, 21 bp, Artificial Sequence
  Description of Artificial Sequence: Synthetic oligonucleotide
  Description of Combined DNA/RNA Molecule: Synthetic oligonucleotide
ucggacgcacgagccgugatt

SEQ ID NO: 1036 - DNA, 21 bp, Artificial Sequence
  Description of Artificial Sequence: Synthetic oligonucleotide
  Description of Combined DNA/RNA Molecule: Synthetic oligonucleotide
cacggcucgugcguccgagtt

SEQ ID NO: 1037 - DNA, 21 bp, Artificial Sequence
  Description of Artificial Sequence: Synthetic oligonucleotide
  Description of Combined DNA/RNA Molecule: Synthetic oligonucleotide
cucggacgcacgagccgugtt

SEQ ID NO: 1038 - DNA, 21 bp, Artificial Sequence
  Description of Artificial Sequence: Synthetic oligonucleotide
  Description of Combined DNA/RNA Molecule: Synthetic oligonucleotide
acggcucgugcguccgagctt

SEQ ID NO: 1039 - DNA, 21 bp, Artificial Sequence
  Description of Artificial Sequence: Synthetic oligonucleotide
  Description of Combined DNA/RNA Molecule: Synthetic oligonucleotide
gcucggacgcacgagccgutt

SEQ ID NO: 1040 - DNA, 21 bp, Artificial Sequence
  Description of Artificial Sequence: Synthetic oligonucleotide
  Description of Combined DNA/RNA Molecule: Synthetic oligonucleotide
gcucgugcguccgagccugtt

SEQ ID NO: 1041 - DNA, 21 bp, Artificial Sequence
  Description of Artificial Sequence: Synthetic oligonucleotide
  Description of Combined DNA/RNA Molecule: Synthetic oligonucleotide
caggcucggacgcacgagctt

SEQ ID NO: 1042 - DNA, 21 bp, Artificial Sequence
  Description of Artificial Sequence: Synthetic oligonucleotide
  Description of Combined DNA/RNA Molecule: Synthetic oligonucleotide
ggaggaagacggcguccgctt

SEQ ID NO: 1043 - DNA, 21 bp, Artificial Sequence
  Description of Artificial Sequence: Synthetic oligonucleotide
  Description of Combined DNA/RNA Molecule: Synthetic oligonucleotide
gcggacgccgucuuccucctt

SEQ ID NO: 1044 - DNA, 21 bp, Artificial Sequence
  Description of Artificial Sequence: Synthetic oligonucleotide
  Description of Combined DNA/RNA Molecule: Synthetic oligonucleotide
gaggaagacggcguccgcatt

SEQ ID NO: 1045 - DNA, 21 bp, Artificial Sequence
  Description of Artificial Sequence: Synthetic oligonucleotide
  Description of Combined DNA/RNA Molecule: Synthetic oligonucleotide
ugcggacgccgucuuccuctt

SEQ ID NO: 1046 - DNA, 21 bp, Artificial Sequence
  Description of Artificial Sequence: Synthetic oligonucleotide
  Description of Combined DNA/RNA Molecule: Synthetic oligonucleotide
ggaagacggcguccgcaagtt

SEQ ID NO: 1047 - DNA, 21 bp, Artificial Sequence
  Description of Artificial Sequence: Synthetic oligonucleotide
  Description of Combined DNA/RNA Molecule: Synthetic oligonucleotide
cuugcggacgccgucuucctt

SEQ ID NO: 1048 - DNA, 21 bp, Artificial Sequence
  Description of Artificial Sequence: Synthetic oligonucleotide
  Description of Combined DNA/RNA Molecule: Synthetic oligonucleotide
gaagacggcguccgcaagutt

SEQ ID NO: 1049 - DNA, 21 bp, Artificial Sequence
  Description of Artificial Sequence: Synthetic oligonucleotide
  Description of Combined DNA/RNA Molecule: Synthetic oligonucleotide
acuugcggacgccgucuuctt

SEQ ID NO: 1050 - DNA, 21 bp, Artificial Sequence
  Description of Artificial Sequence: Synthetic oligonucleotide
  Description of Combined DNA/RNA Molecule: Synthetic oligonucleotide
aagacggcguccgcaagugtt

SEQ ID NO: 1051 - DNA, 21 bp, Artificial Sequence
  Description of Artificial Sequence: Synthetic oligonucleotide
  Description of Combined DNA/RNA Molecule: Synthetic oligonucleotide
cacuugcggacgccgucuutt

SEQ ID NO: 1052 - DNA, 21 bp, Artificial Sequence
  Description of Artificial Sequence: Synthetic oligonucleotide
  Description of Combined DNA/RNA Molecule: Synthetic oligonucleotide
gacggcguccgcaaguguatt

SEQ ID NO: 1053 - DNA, 21 bp, Artificial Sequence
  Description of Artificial Sequence: Synthetic oligonucleotide
  Description of Combined DNA/RNA Molecule: Synthetic oligonucleotide
uacacuugcggacgccguctt

SEQ ID NO: 1054 - DNA, 21 bp, Artificial Sequence
  Description of Artificial Sequence: Synthetic oligonucleotide
  Description of Combined DNA/RNA Molecule: Synthetic oligonucleotide
acggcguccgcaaguguaatt

SEQ ID NO: 1055 - DNA, 21 bp, Artificial Sequence
  Description of Artificial Sequence: Synthetic oligonucleotide
  Description of Combined DNA/RNA Molecule: Synthetic oligonucleotide
uuacacuugcggacgccgutt

SEQ ID NO: 1056 - DNA, 21 bp, Artificial Sequence
  Description of Artificial Sequence: Synthetic oligonucleotide
  Description of Combined DNA/RNA Molecule: Synthetic oligonucleotide
gcguccgcaaguguaagaatt

SEQ ID NO: 1057 - DNA, 21 bp, Artificial Sequence
  Description of Artificial Sequence: Synthetic oligonucleotide
  Description of Combined DNA/RNA Molecule: Synthetic oligonucleotide
uucuuacacuugcggacgctt

SEQ ID NO: 1058 - DNA, 21 bp, Artificial Sequence
  Description of Artificial Sequence: Synthetic oligonucleotide
  Description of Combined DNA/RNA Molecule: Synthetic oligonucleotide
cguccgcaaguguaagaagtt

SEQ ID NO: 1059 - DNA, 21 bp, Artificial Sequence
  Description of Artificial Sequence: Synthetic oligonucleotide
  Description of Combined DNA/RNA Molecule: Synthetic oligonucleotide
cuucuuacacuugcggacgtt

SEQ ID NO: 1060 - DNA, 21 bp, Artificial Sequence
  Description of Artificial Sequence: Synthetic oligonucleotide
  Description of Combined DNA/RNA Molecule: Synthetic oligonucleotide
guccgcaaguguaagaagutt

SEQ ID NO: 1061 - DNA, 21 bp, Artificial Sequence
  Description of Artificial Sequence: Synthetic oligonucleotide
  Description of Combined DNA/RNA Molecule: Synthetic oligonucleotide
acuucuuacacuugcggactt

SEQ ID NO: 1062 - DNA, 21 bp, Artificial Sequence
  Description of Artificial Sequence: Synthetic oligonucleotide
  Description of Combined DNA/RNA Molecule: Synthetic oligonucleotide
uccgcaaguguaagaagugtt

SEQ ID NO: 1063 - DNA, 21 bp, Artificial Sequence
  Description of Artificial Sequence: Synthetic oligonucleotide
  Description of Combined DNA/RNA Molecule: Synthetic oligonucleotide
cacuucuuacacuugcggatt

SEQ ID NO: 1064 - DNA, 21 bp, Artificial Sequence
  Description of Artificial Sequence: Synthetic oligonucleotide
  Description of Combined DNA/RNA Molecule: Synthetic oligonucleotide
ccgcaaguguaagaagugctt

SEQ ID NO: 1065 - DNA, 21 bp, Artificial Sequence
  Description of Artificial Sequence: Synthetic oligonucleotide
  Description of Combined DNA/RNA Molecule: Synthetic oligonucleotide
gcacuucuuacacuugcggtt

SEQ ID NO: 1066 - DNA, 21 bp, Artificial Sequence
  Description of Artificial Sequence: Synthetic oligonucleotide
  Description of Combined DNA/RNA Molecule: Synthetic oligonucleotide
cgcaaguguaagaagugcgtt

SEQ ID NO: 1067 - DNA, 21 bp, Artificial Sequence
  Description of Artificial Sequence: Synthetic oligonucleotide
  Description of Combined DNA/RNA Molecule: Synthetic oligonucleotide
cgcacuucuuacacuugcgtt

SEQ ID NO: 1068 - DNA, 21 bp, Artificial Sequence
  Description of Artificial Sequence: Synthetic oligonucleotide
  Description of Combined DNA/RNA Molecule: Synthetic oligonucleotide
gcaaguguaagaagugcgatt

SEQ ID NO: 1069 - DNA, 21 bp, Artificial Sequence
  Description of Artificial Sequence: Synthetic oligonucleotide
  Description of Combined DNA/RNA Molecule: Synthetic oligonucleotide
ucgcacuucuuacacuugctt

SEQ ID NO: 1070 - DNA, 21 bp, Artificial Sequence
  Description of Artificial Sequence: Synthetic oligonucleotide
  Description of Combined DNA/RNA Molecule: Synthetic oligonucleotide
aaguguaagaagugcgaagtt

SEQ ID NO: 1071 - DNA, 21 bp, Artificial Sequence
  Description of Artificial Sequence: Synthetic oligonucleotide
  Description of Combined DNA/RNA Molecule: Synthetic oligonucleotide
cuucgcacuucuuacacuutt

SEQ ID NO: 1072 - DNA, 21 bp, Artificial Sequence
  Description of Artificial Sequence: Synthetic oligonucleotide
  Description of Combined DNA/RNA Molecule: Synthetic oligonucleotide
aguguaagaagugcgaaggtt

SEQ ID NO: 1073 - DNA, 21 bp, Artificial Sequence
  Description of Artificial Sequence: Synthetic oligonucleotide
  Description of Combined DNA/RNA Molecule: Synthetic oligonucleotide
ccuucgcacuucuuacacutt

SEQ ID NO: 1074 - DNA, 21 bp, Artificial Sequence
  Description of Artificial Sequence: Synthetic oligonucleotide
  Description of Combined DNA/RNA Molecule: Synthetic oligonucleotide
guguaagaagugcgaagggtt

SEQ ID NO: 1075 - DNA, 21 bp, Artificial Sequence
  Description of Artificial Sequence: Synthetic oligonucleotide
  Description of Combined DNA/RNA Molecule: Synthetic oligonucleotide
cccuucgcacuucuuacactt

SEQ ID NO: 1076 - DNA, 21 bp, Artificial Sequence
  Description of Artificial Sequence: Synthetic oligonucleotide
  Description of Combined DNA/RNA Molecule: Synthetic oligonucleotide
uguaagaagugcgaagggctt

SEQ ID NO: 1077 - DNA, 21 bp, Artificial Sequence
  Description of Artificial Sequence: Synthetic oligonucleotide
  Description of Combined DNA/RNA Molecule: Synthetic oligonucleotide
gcccuucgcacuucuuacatt

SEQ ID NO: 1078 - DNA, 21 bp, Artificial Sequence
  Description of Artificial Sequence: Synthetic oligonucleotide
  Description of Combined DNA/RNA Molecule: Synthetic oligonucleotide
guaagaagugcgaagggcctt

SEQ ID NO: 1079 - DNA, 21 bp, Artificial Sequence
  Description of Artificial Sequence: Synthetic oligonucleotide
  Description of Combined DNA/RNA Molecule: Synthetic oligonucleotide
ggcccuucgcacuucuuactt

SEQ ID NO: 1080 - DNA, 21 bp, Artificial Sequence
  Description of Artificial Sequence: Synthetic oligonucleotide
  Description of Combined DNA/RNA Molecule: Synthetic oligonucleotide
uaagaagugcgaagggccutt

SEQ ID NO: 1081 - DNA, 21 bp, Artificial Sequence
  Description of Artificial Sequence: Synthetic oligonucleotide
  Description of Combined DNA/RNA Molecule: Synthetic oligonucleotide
aggcccuucgcacuucuuatt

SEQ ID NO: 1082 - DNA, 21 bp, Artificial Sequence
  Description of Artificial Sequence: Synthetic oligonucleotide
  Description of Combined DNA/RNA Molecule: Synthetic oligonucleotide
aagaagugcgaagggccuutt

SEQ ID NO: 1083 - DNA, 21 bp, Artificial Sequence
  Description of Artificial Sequence: Synthetic oligonucleotide
  Description of Combined DNA/RNA Molecule: Synthetic oligonucleotide
aaggcccuucgcacuucuutt

SEQ ID NO: 1084 - DNA, 21 bp, Artificial Sequence
  Description of Artificial Sequence: Synthetic oligonucleotide
  Description of Combined DNA/RNA Molecule: Synthetic oligonucleotide
agaagugcgaagggccuugtt

SEQ ID NO: 1085 - DNA, 21 bp, Artificial Sequence
  Description of Artificial Sequence: Synthetic oligonucleotide
  Description of Combined DNA/RNA Molecule: Synthetic oligonucleotide
caaggcccuucgcacuucutt

SEQ ID NO: 1086 - DNA, 21 bp, Artificial Sequence
  Description of Artificial Sequence: Synthetic oligonucleotide
  Description of Combined DNA/RNA Molecule: Synthetic oligonucleotide
agugcgaagggccuugccgtt

SEQ ID NO: 1087 - DNA, 21 bp, Artificial Sequence
  Description of Artificial Sequence: Synthetic oligonucleotide
  Description of Combined DNA/RNA Molecule: Synthetic oligonucleotide
cggcaaggcccuucgcacutt

SEQ ID NO: 1088 - DNA, 21 bp, Artificial Sequence
  Description of Artificial Sequence: Synthetic oligonucleotide
  Description of Combined DNA/RNA Molecule: Synthetic oligonucleotide
gugcgaagggccuugccgctt

SEQ ID NO: 1089 - DNA, 21 bp, Artificial Sequence
  Description of Artificial Sequence: Synthetic oligonucleotide
  Description of Combined DNA/RNA Molecule: Synthetic oligonucleotide
gcggcaaggcccuucgcactt

SEQ ID NO: 1090 - DNA, 21 bp, Artificial Sequence
  Description of Artificial Sequence: Synthetic oligonucleotide
  Description of Combined DNA/RNA Molecule: Synthetic oligonucleotide
ugcgaagggccuugccgcatt

SEQ ID NO: 1091 - DNA, 21 bp, Artificial Sequence
  Description of Artificial Sequence: Synthetic oligonucleotide
  Description of Combined DNA/RNA Molecule: Synthetic oligonucleotide
ugcggcaaggcccuucgcatt

SEQ ID NO: 1092 - DNA, 21 bp, Artificial Sequence
  Description of Artificial Sequence: Synthetic oligonucleotide
  Description of Combined DNA/RNA Molecule: Synthetic oligonucleotide
gcgaagggccuugccgcaatt

SEQ ID NO: 1093 - DNA, 21 bp, Artificial Sequence
  Description of Artificial Sequence: Synthetic oligonucleotide
  Description of Combined DNA/RNA Molecule: Synthetic oligonucleotide
uugcggcaaggcccuucgctt

SEQ ID NO: 1094 - DNA, 21 bp, Artificial Sequence
  Description of Artificial Sequence: Synthetic oligonucleotide
  Description of Combined DNA/RNA Molecule: Synthetic oligonucleotide
cgaagggccuugccgcaaatt

SEQ ID NO: 1095 - DNA, 21 bp, Artificial Sequence
  Description of Artificial Sequence: Synthetic oligonucleotide
  Description of Combined DNA/RNA Molecule: Synthetic oligonucleotide
uuugcggcaaggcccuucgtt

SEQ ID NO: 1096 - DNA, 21 bp, Artificial Sequence
  Description of Artificial Sequence: Synthetic oligonucleotide
  Description of Combined DNA/RNA Molecule: Synthetic oligonucleotide
aagggccuugccgcaaagutt

SEQ ID NO: 1097 - DNA, 21 bp, Artificial Sequence
  Description of Artificial Sequence: Synthetic oligonucleotide
  Description of Combined DNA/RNA Molecule: Synthetic oligonucleotide
acuuugcggcaaggcccuutt

SEQ ID NO: 1098 - DNA, 21 bp, Artificial Sequence
  Description of Artificial Sequence: Synthetic oligonucleotide
  Description of Combined DNA/RNA Molecule: Synthetic oligonucleotide
agggccuugccgcaaagugtt

SEQ ID NO: 1099 - DNA, 21 bp, Artificial Sequence
  Description of Artificial Sequence: Synthetic oligonucleotide
  Description of Combined DNA/RNA Molecule: Synthetic oligonucleotide
cacuuugcggcaaggcccutt

SEQ ID NO: 1100 - DNA, 21 bp, Artificial Sequence
  Description of Artificial Sequence: Synthetic oligonucleotide
  Description of Combined DNA/RNA Molecule: Synthetic oligonucleotide
gggccuugccgcaaagugutt

SEQ ID NO: 1101 - DNA, 21 bp, Artificial Sequence
  Description of Artificial Sequence: Synthetic oligonucleotide
  Description of Combined DNA/RNA Molecule: Synthetic oligonucleotide
acacuuugcggcaaggccctt

SEQ ID NO: 1102 - DNA, 21 bp, Artificial Sequence
  Description of Artificial Sequence: Synthetic oligonucleotide
  Description of Combined DNA/RNA Molecule: Synthetic oligonucleotide
ggccuugccgcaaagugugtt

SEQ ID NO: 1103 - DNA, 21 bp, Artificial Sequence
  Description of Artificial Sequence: Synthetic oligonucleotide
  Description of Combined DNA/RNA Molecule: Synthetic oligonucleotide
cacacuuugcggcaaggcctt

SEQ ID NO: 1104 - DNA, 21 bp, Artificial Sequence
  Description of Artificial Sequence: Synthetic oligonucleotide
  Description of Combined DNA/RNA Molecule: Synthetic oligonucleotide
gccuugccgcaaagugugutt

SEQ ID NO: 1105 - DNA, 21 bp, Artificial Sequence
  Description of Artificial Sequence: Synthetic oligonucleotide
  Description of Combined DNA/RNA Molecule: Synthetic oligonucleotide
acacacuuugcggcaaggctt

SEQ ID NO: 1106 - DNA, 21 bp, Artificial Sequence
  Description of Artificial Sequence: Synthetic oligonucleotide
  Description of Combined DNA/RNA Molecule: Synthetic oligonucleotide
cuugccgcaaaguguguaatt

SEQ ID NO: 1107 - DNA, 21 bp, Artificial Sequence
  Description of Artificial Sequence: Synthetic oligonucleotide
  Description of Combined DNA/RNA Molecule: Synthetic oligonucleotide
uuacacacuuugcggcaagtt

SEQ ID NO: 1108 - DNA, 21 bp, Artificial Sequence
  Description of Artificial Sequence: Synthetic oligonucleotide
  Description of Combined DNA/RNA Molecule: Synthetic oligonucleotide
ggaauagguauuggugaautt

SEQ ID NO: 1109 - DNA, 21 bp, Artificial Sequence
  Description of Artificial Sequence: Synthetic oligonucleotide
  Description of Combined DNA/RNA Molecule: Synthetic oligonucleotide
auucaccaauaccuauucctt

SEQ ID NO: 1110 - DNA, 21 bp, Artificial Sequence
  Description of Artificial Sequence: Synthetic oligonucleotide
  Description of Combined DNA/RNA Molecule: Synthetic oligonucleotide
gaauagguauuggugaauutt

SEQ ID NO: 1111 - DNA, 21 bp, Artificial Sequence
  Description of Artificial Sequence: Synthetic oligonucleotide
  Description of Combined DNA/RNA Molecule: Synthetic oligonucleotide
aauucaccaauaccuauuctt

SEQ ID NO: 1112 - DNA, 21 bp, Artificial Sequence
  Description of Artificial Sequence: Synthetic oligonucleotide
  Description of Combined DNA/RNA Molecule: Synthetic oligonucleotide
aauagguauuggugaauuutt

SEQ ID NO: 1113 - DNA, 21 bp, Artificial Sequence
  Description of Artificial Sequence: Synthetic oligonucleotide
  Description of Combined DNA/RNA Molecule: Synthetic oligonucleotide
aaauucaccaauaccuauutt

SEQ ID NO: 1114 - DNA, 21 bp, Artificial Sequence
  Description of Artificial Sequence: Synthetic oligonucleotide
  Description of Combined DNA/RNA Molecule: Synthetic oligonucleotide
auagguauuggugaauuuatt

SEQ ID NO: 1115 - DNA, 21 bp, Artificial Sequence
  Description of Artificial Sequence: Synthetic oligonucleotide
  Description of Combined DNA/RNA Molecule: Synthetic oligonucleotide
uaaauucaccaauaccuautt

SEQ ID NO: 1116 - DNA, 21 bp, Artificial Sequence
  Description of Artificial Sequence: Synthetic oligonucleotide
  Description of Combined DNA/RNA Molecule: Synthetic oligonucleotide
agguauuggugaauuuaaatt

SEQ ID NO: 1117 - DNA, 21 bp, Artificial Sequence
  Description of Artificial Sequence: Synthetic oligonucleotide
  Description of Combined DNA/RNA Molecule: Synthetic oligonucleotide
uuuaaauucaccaauaccutt

SEQ ID NO: 1118 - DNA, 21 bp, Artificial Sequence
  Description of Artificial Sequence: Synthetic oligonucleotide
  Description of Combined DNA/RNA Molecule: Synthetic oligonucleotide
gguauuggugaauuuaaagtt

SEQ ID NO: 1119 - DNA, 21 bp, Artificial Sequence
  Description of Artificial Sequence: Synthetic oligonucleotide
  Description of Combined DNA/RNA Molecule: Synthetic oligonucleotide
cuuuaaauucaccaauacctt

SEQ ID NO: 1120 - DNA, 21 bp, Artificial Sequence
  Description of Artificial Sequence: Synthetic oligonucleotide
  Description of Combined DNA/RNA Molecule: Synthetic oligonucleotide
cacucuccauaaaugcuactt

SEQ ID NO: 1121 - DNA, 21 bp, Artificial Sequence
  Description of Artificial Sequence: Synthetic oligonucleotide
  Description of Combined DNA/RNA Molecule: Synthetic oligonucleotide
guagcauuuauggagagugtt

SEQ ID NO: 1122 - DNA, 21 bp, Artificial Sequence
  Description of Artificial Sequence: Synthetic oligonucleotide
  Description of Combined DNA/RNA Molecule: Synthetic oligonucleotide
uuaaacacuucaaaaacugtt

SEQ ID NO: 1123 - DNA, 21 bp, Artificial Sequence
  Description of Artificial Sequence: Synthetic oligonucleotide
  Description of Combined DNA/RNA Molecule: Synthetic oligonucleotide
caguuuuugaaguguuuaatt

SEQ ID NO: 1124 - DNA, 21 bp, Artificial Sequence
  Description of Artificial Sequence: Synthetic oligonucleotide
  Description of Combined DNA/RNA Molecule: Synthetic oligonucleotide
cuucaaaaacugcaccucctt

SEQ ID NO: 1125 - DNA, 21 bp, Artificial Sequence
  Description of Artificial Sequence: Synthetic oligonucleotide
  Description of Combined DNA/RNA Molecule: Synthetic oligonucleotide
ggaggugcaguuuuugaagtt

SEQ ID NO: 1126 - DNA, 21 bp, Artificial Sequence
  Description of Artificial Sequence: Synthetic oligonucleotide
  Description of Combined DNA/RNA Molecule: Synthetic oligonucleotide
uucaaaaacugcaccuccatt

SEQ ID NO: 1127 - DNA, 21 bp, Artificial Sequence
  Description of Artificial Sequence: Synthetic oligonucleotide
  Description of Combined DNA/RNA Molecule: Synthetic oligonucleotide
uggaggugcaguuuuugaatt

SEQ ID NO: 1128 - DNA, 21 bp, Artificial Sequence
  Description of Artificial Sequence: Synthetic oligonucleotide
  Description of Combined DNA/RNA Molecule: Synthetic oligonucleotide
ucaaaaacugcaccuccautt

SEQ ID NO: 1129 - DNA, 21 bp, Artificial Sequence
  Description of Artificial Sequence: Synthetic oligonucleotide
  Description of Combined DNA/RNA Molecule: Synthetic oligonucleotide
auggaggugcaguuuuugatt

SEQ ID NO: 1130 - DNA, 21 bp, Artificial Sequence
  Description of Artificial Sequence: Synthetic oligonucleotide
  Description of Combined DNA/RNA Molecule: Synthetic oligonucleotide
caaaaacugcaccuccauctt

SEQ ID NO: 1131 - DNA, 21 bp, Artificial Sequence
  Description of Artificial Sequence: Synthetic oligonucleotide
  Description of Combined DNA/RNA Molecule: Synthetic oligonucleotide
gauggaggugcaguuuuugtt

SEQ ID NO: 1132 - DNA, 21 bp, Artificial Sequence
  Description of Artificial Sequence: Synthetic oligonucleotide
  Description of Combined DNA/RNA Molecule: Synthetic oligonucleotide
aaaaacugcaccuccaucatt

SEQ ID NO: 1133 - DNA, 21 bp, Artificial Sequence
  Description of Artificial Sequence: Synthetic oligonucleotide
  Description of Combined DNA/RNA Molecule: Synthetic oligonucleotide
ugauggaggugcaguuuuutt

SEQ ID NO: 1134 - DNA, 21 bp, Artificial Sequence
  Description of Artificial Sequence: Synthetic oligonucleotide
  Description of Combined DNA/RNA Molecule: Synthetic oligonucleotide
acugcaccuccaucaguggtt

SEQ ID NO: 1135 - DNA, 21 bp, Artificial Sequence
  Description of Artificial Sequence: Synthetic oligonucleotide
  Description of Combined DNA/RNA Molecule: Synthetic oligonucleotide
ccacugauggaggugcagutt

SEQ ID NO: 1136 - DNA, 21 bp, Artificial Sequence
  Description of Artificial Sequence: Synthetic oligonucleotide
  Description of Combined DNA/RNA Molecule: Synthetic oligonucleotide
caccuccaucaguggcgautt

SEQ ID NO: 1137 - DNA, 21 bp, Artificial Sequence
  Description of Artificial Sequence: Synthetic oligonucleotide
  Description of Combined DNA/RNA Molecule: Synthetic oligonucleotide
aucgccacugauggaggugtt

SEQ ID NO: 1138 - DNA, 21 bp, Artificial Sequence
  Description of Artificial Sequence: Synthetic oligonucleotide
  Description of Combined DNA/RNA Molecule: Synthetic oligonucleotide
accuccaucaguggcgauctt

SEQ ID NO: 1139 - DNA, 21 bp, Artificial Sequence
  Description of Artificial Sequence: Synthetic oligonucleotide
  Description of Combined DNA/RNA Molecule: Synthetic oligonucleotide
gaucgccacugauggaggutt

SEQ ID NO: 1140 - DNA, 21 bp, Artificial Sequence
  Description of Artificial Sequence: Synthetic oligonucleotide
  Description of Combined DNA/RNA Molecule: Synthetic oligonucleotide
cuccaucaguggcgaucuctt

SEQ ID NO: 1141 - DNA, 21 bp, Artificial Sequence
  Description of Artificial Sequence: Synthetic oligonucleotide
  Description of Combined DNA/RNA Molecule: Synthetic oligonucleotide
gagaucgccacugauggagtt

SEQ ID NO: 1142 - DNA, 21 bp, Artificial Sequence
  Description of Artificial Sequence: Synthetic oligonucleotide
  Description of Combined DNA/RNA Molecule: Synthetic oligonucleotide
caucaguggcgaucuccactt

SEQ ID NO: 1143 - DNA, 21 bp, Artificial Sequence
  Description of Artificial Sequence: Synthetic oligonucleotide
  Description of Combined DNA/RNA Molecule: Synthetic oligonucleotide
guggagaucgccacugaugtt

SEQ ID NO: 1144 - DNA, 21 bp, Artificial Sequence
  Description of Artificial Sequence: Synthetic oligonucleotide
  Description of Combined DNA/RNA Molecule: Synthetic oligonucleotide
uggcgaucuccacauccugtt

SEQ ID NO: 1145 - DNA, 21 bp, Artificial Sequence
  Description of Artificial Sequence: Synthetic oligonucleotide
  Description of Combined DNA/RNA Molecule: Synthetic oligonucleotide
caggauguggagaucgccatt

SEQ ID NO: 1146 - DNA, 21 bp, Artificial Sequence
  Description of Artificial Sequence: Synthetic oligonucleotide
  Description of Combined DNA/RNA Molecule: Synthetic oligonucleotide
ggcgaucuccacauccugctt

SEQ ID NO: 1147 - DNA, 21 bp, Artificial Sequence
  Description of Artificial Sequence: Synthetic oligonucleotide
  Description of Combined DNA/RNA Molecule: Synthetic oligonucleotide
gcaggauguggagaucgcctt

SEQ ID NO: 1148 - DNA, 21 bp, Artificial Sequence
  Description of Artificial Sequence: Synthetic oligonucleotide
  Description of Combined DNA/RNA Molecule: Synthetic oligonucleotide
gcgaucuccacauccugcctt

SEQ ID NO: 1149 - DNA, 21 bp, Artificial Sequence
  Description of Artificial Sequence: Synthetic oligonucleotide
  Description of Combined DNA/RNA Molecule: Synthetic oligonucleotide
ggcaggauguggagaucgctt

SEQ ID NO: 1150 - DNA, 21 bp, Artificial Sequence
  Description of Artificial Sequence: Synthetic oligonucleotide
  Description of Combined DNA/RNA Molecule: Synthetic oligonucleotide
cgaucuccacauccugccgtt

SEQ ID NO: 1151 - DNA, 21 bp, Artificial Sequence
  Description of Artificial Sequence: Synthetic oligonucleotide
  Description of Combined DNA/RNA Molecule: Synthetic oligonucleotide
cggcaggauguggagaucgtt

SEQ ID NO: 1152 - DNA, 21 bp, Artificial Sequence
  Description of Artificial Sequence: Synthetic oligonucleotide
  Description of Combined DNA/RNA Molecule: Synthetic oligonucleotide
gaucuccacauccugccggtt

SEQ ID NO: 1153 - DNA, 21 bp, Artificial Sequence
  Description of Artificial Sequence: Synthetic oligonucleotide
  Description of Combined DNA/RNA Molecule: Synthetic oligonucleotide
ccggcaggauguggagauctt

SEQ ID NO: 1154 - DNA, 21 bp, Artificial Sequence
  Description of Artificial Sequence: Synthetic oligonucleotide
  Description of Combined DNA/RNA Molecule: Synthetic oligonucleotide
ccacauccugccgguggcatt

SEQ ID NO: 1155 - DNA, 21 bp, Artificial Sequence
  Description of Artificial Sequence: Synthetic oligonucleotide
  Description of Combined DNA/RNA Molecule: Synthetic oligonucleotide
ugccaccggcaggauguggtt

SEQ ID NO: 1156 - DNA, 21 bp, Artificial Sequence
  Description of Artificial Sequence: Synthetic oligonucleotide
  Description of Combined DNA/RNA Molecule: Synthetic oligonucleotide
cacauccugccgguggcautt

SEQ ID NO: 1157 - DNA, 21 bp, Artificial Sequence
  Description of Artificial Sequence: Synthetic oligonucleotide
  Description of Combined DNA/RNA Molecule: Synthetic oligonucleotide
augccaccggcaggaugugtt

SEQ ID NO: 1158 - DNA, 21 bp, Artificial Sequence
  Description of Artificial Sequence: Synthetic oligonucleotide
  Description of Combined DNA/RNA Molecule: Synthetic oligonucleotide
acauccugccgguggcauutt

SEQ ID NO: 1159 - DNA, 21 bp, Artificial Sequence
  Description of Artificial Sequence: Synthetic oligonucleotide
  Description of Combined DNA/RNA Molecule: Synthetic oligonucleotide
aaugccaccggcaggaugutt

SEQ ID NO: 1160 - DNA, 21 bp, Artificial Sequence
  Description of Artificial Sequence: Synthetic oligonucleotide
  Description of Combined DNA/RNA Molecule: Synthetic oligonucleotide
auccugccgguggcauuuatt

SEQ ID NO: 1161 - DNA, 21 bp, Artificial Sequence
  Description of Artificial Sequence: Synthetic oligonucleotide
  Description of Combined DNA/RNA Molecule: Synthetic oligonucleotide
uaaaugccaccggcaggautt

SEQ ID NO: 1162 - DNA, 21 bp, Artificial Sequence
  Description of Artificial Sequence: Synthetic oligonucleotide
  Description of Combined DNA/RNA Molecule: Synthetic oligonucleotide
cugccgguggcauuuagggtt

SEQ ID NO: 1163 - DNA, 21 bp, Artificial Sequence
  Description of Artificial Sequence: Synthetic oligonucleotide
  Description of Combined DNA/RNA Molecule: Synthetic oligonucleotide
cccuaaaugccaccggcagtt

SEQ ID NO: 1164 - DNA, 21 bp, Artificial Sequence
  Description of Artificial Sequence: Synthetic oligonucleotide
  Description of Combined DNA/RNA Molecule: Synthetic oligonucleotide
ugccgguggcauuuaggggtt

SEQ ID NO: 1165 - DNA, 21 bp, Artificial Sequence
  Description of Artificial Sequence: Synthetic oligonucleotide
  Description of Combined DNA/RNA Molecule: Synthetic oligonucleotide
ccccuaaaugccaccggcatt

SEQ ID NO: 1166 - DNA, 21 bp, Artificial Sequence
  Description of Artificial Sequence: Synthetic oligonucleotide
  Description of Combined DNA/RNA Molecule: Synthetic oligonucleotide
gccgguggcauuuaggggutt

SEQ ID NO: 1167 - DNA, 21 bp, Artificial Sequence
  Description of Artificial Sequence: Synthetic oligonucleotide
  Description of Combined DNA/RNA Molecule: Synthetic oligonucleotide
accccuaaaugccaccggctt

SEQ ID NO: 1168 - DNA, 21 bp, Artificial Sequence
  Description of Artificial Sequence: Synthetic oligonucleotide
  Description of Combined DNA/RNA Molecule: Synthetic oligonucleotide
ccgguggcauuuaggggugtt

SEQ ID NO: 1169 - DNA, 21 bp, Artificial Sequence
  Description of Artificial Sequence: Synthetic oligonucleotide
  Description of Combined DNA/RNA Molecule: Synthetic oligonucleotide
caccccuaaaugccaccggtt

SEQ ID NO: 1170 - DNA, 21 bp, Artificial Sequence
  Description of Artificial Sequence: Synthetic oligonucleotide
  Description of Combined DNA/RNA Molecule: Synthetic oligonucleotide
guggcauuuaggggugacutt

SEQ ID NO: 1171 - DNA, 21 bp, Artificial Sequence
  Description of Artificial Sequence: Synthetic oligonucleotide
  Description of Combined DNA/RNA Molecule: Synthetic oligonucleotide
agucaccccuaaaugccactt

SEQ ID NO: 1172 - DNA, 21 bp, Artificial Sequence
  Description of Artificial Sequence: Synthetic oligonucleotide
  Description of Combined DNA/RNA Molecule: Synthetic oligonucleotide
gcauuuaggggugacuccutt

SEQ ID NO: 1173 - DNA, 21 bp, Artificial Sequence
  Description of Artificial Sequence: Synthetic oligonucleotide
  Description of Combined DNA/RNA Molecule: Synthetic oligonucleotide
aggagucaccccuaaaugctt

SEQ ID NO: 1174 - DNA, 21 bp, Artificial Sequence
  Description of Artificial Sequence: Synthetic oligonucleotide
  Description of Combined DNA/RNA Molecule: Synthetic oligonucleotide
cauuuaggggugacuccuutt

SEQ ID NO: 1175 - DNA, 21 bp, Artificial Sequence
  Description of Artificial Sequence: Synthetic oligonucleotide
  Description of Combined DNA/RNA Molecule: Synthetic oligonucleotide
aaggagucaccccuaaaugtt

SEQ ID NO: 1176 - DNA, 21 bp, Artificial Sequence
  Description of Artificial Sequence: Synthetic oligonucleotide
  Description of Combined DNA/RNA Molecule: Synthetic oligonucleotide
auuuaggggugacuccuuctt

SEQ ID NO: 1177 - DNA, 21 bp, Artificial Sequence
  Description of Artificial Sequence: Synthetic oligonucleotide
  Description of Combined DNA/RNA Molecule: Synthetic oligonucleotide
gaaggagucaccccuaaautt

SEQ ID NO: 1178 - DNA, 21 bp, Artificial Sequence
  Description of Artificial Sequence: Synthetic oligonucleotide
  Description of Combined DNA/RNA Molecule: Synthetic oligonucleotide
uuuaggggugacuccuucatt

SEQ ID NO: 1179 - DNA, 21 bp, Artificial Sequence
  Description of Artificial Sequence: Synthetic oligonucleotide
  Description of Combined DNA/RNA Molecule: Synthetic oligonucleotide
ugaaggagucaccccuaaatt

SEQ ID NO: 1180 - DNA, 21 bp, Artificial Sequence
  Description of Artificial Sequence: Synthetic oligonucleotide
  Description of Combined DNA/RNA Molecule: Synthetic oligonucleotide
uuaggggugacuccuucactt

SEQ ID NO: 1181 - DNA, 21 bp, Artificial Sequence
  Description of Artificial Sequence: Synthetic oligonucleotide
  Description of Combined DNA/RNA Molecule: Synthetic oligonucleotide
gugaaggagucaccccuaatt

SEQ ID NO: 1182 - DNA, 21 bp, Artificial Sequence
  Description of Artificial Sequence: Synthetic oligonucleotide
  Description of Combined DNA/RNA Molecule: Synthetic oligonucleotide
uaggggugacuccuucacatt

SEQ ID NO: 1183 - DNA, 21 bp, Artificial Sequence
  Description of Artificial Sequence: Synthetic oligonucleotide
  Description of Combined DNA/RNA Molecule: Synthetic oligonucleotide
ugugaaggagucaccccuatt

SEQ ID NO: 1184 - DNA, 21 bp, Artificial Sequence
  Description of Artificial Sequence: Synthetic oligonucleotide
  Description of Combined DNA/RNA Molecule: Synthetic oligonucleotide
ucuggauccacaggaacugtt

SEQ ID NO: 1185 - DNA, 21 bp, Artificial Sequence
  Description of Artificial Sequence: Synthetic oligonucleotide
  Description of Combined DNA/RNA Molecule: Synthetic oligonucleotide
caguuccuguggauccagatt

SEQ ID NO: 1186 - DNA, 21 bp, Artificial Sequence
  Description of Artificial Sequence: Synthetic oligonucleotide
  Description of Combined DNA/RNA Molecule: Synthetic oligonucleotide
gauccacaggaacuggauatt

SEQ ID NO: 1187 - DNA, 21 bp, Artificial Sequence
  Description of Artificial Sequence: Synthetic oligonucleotide
  Description of Combined DNA/RNA Molecule: Synthetic oligonucleotide
uauccaguuccuguggauctt

SEQ ID NO: 1188 - DNA, 21 bp, Artificial Sequence
  Description of Artificial Sequence: Synthetic oligonucleotide
  Description of Combined DNA/RNA Molecule: Synthetic oligonucleotide
auccacaggaacuggauautt

SEQ ID NO: 1189 - DNA, 21 bp, Artificial Sequence
  Description of Artificial Sequence: Synthetic oligonucleotide
  Description of Combined DNA/RNA Molecule: Synthetic oligonucleotide
auauccaguuccuguggautt

SEQ ID NO: 1190 - DNA, 21 bp, Artificial Sequence
  Description of Artificial Sequence: Synthetic oligonucleotide
  Description of Combined DNA/RNA Molecule: Synthetic oligonucleotide
ccacaggaacuggauauuctt

SEQ ID NO: 1191 - DNA, 21 bp, Artificial Sequence
  Description of Artificial Sequence: Synthetic oligonucleotide
  Description of Combined DNA/RNA Molecule: Synthetic oligonucleotide
gaauauccaguuccuguggtt

SEQ ID NO: 1192 - DNA, 21 bp, Artificial Sequence
  Description of Artificial Sequence: Synthetic oligonucleotide
  Description of Combined DNA/RNA Molecule: Synthetic oligonucleotide
cacaggaacuggauauucutt

SEQ ID NO: 1193 - DNA, 21 bp, Artificial Sequence
  Description of Artificial Sequence: Synthetic oligonucleotide
  Description of Combined DNA/RNA Molecule: Synthetic oligonucleotide
agaauauccaguuccugugtt

SEQ ID NO: 1194 - DNA, 21 bp, Artificial Sequence
  Description of Artificial Sequence: Synthetic oligonucleotide
  Description of Combined DNA/RNA Molecule: Synthetic oligonucleotide
acuggauauucugaaaacctt

SEQ ID NO: 1195 - DNA, 21 bp, Artificial Sequence
  Description of Artificial Sequence: Synthetic oligonucleotide
  Description of Combined DNA/RNA Molecule: Synthetic oligonucleotide
gguuuucagaauauccagutt

SEQ ID NO: 1196 - DNA, 21 bp, Artificial Sequence
  Description of Artificial Sequence: Synthetic oligonucleotide
  Description of Combined DNA/RNA Molecule: Synthetic oligonucleotide
auucugaaaaccguaaaggtt

SEQ ID NO: 1197 - DNA, 21 bp, Artificial Sequence
  Description of Artificial Sequence: Synthetic oligonucleotide
  Description of Combined DNA/RNA Molecule: Synthetic oligonucleotide
ccuuuacgguuuucagaautt

SEQ ID NO: 1198 - DNA, 21 bp, Artificial Sequence
  Description of Artificial Sequence: Synthetic oligonucleotide
  Description of Combined DNA/RNA Molecule: Synthetic oligonucleotide
uucugaaaaccguaaaggatt

SEQ ID NO: 1199 - DNA, 21 bp, Artificial Sequence
  Description of Artificial Sequence: Synthetic oligonucleotide
  Description of Combined DNA/RNA Molecule: Synthetic oligonucleotide
uccuuuacgguuuucagaatt

SEQ ID NO: 1200 - DNA, 21 bp, Artificial Sequence
  Description of Artificial Sequence: Synthetic oligonucleotide
  Description of Combined DNA/RNA Molecule: Synthetic oligonucleotide
ugaaaaccguaaaggaaautt

SEQ ID NO: 1201 - DNA, 21 bp, Artificial Sequence
  Description of Artificial Sequence: Synthetic oligonucleotide
  Description of Combined DNA/RNA Molecule: Synthetic oligonucleotide
auuuccuuuacgguuuucatt

SEQ ID NO: 1202 - DNA, 21 bp, Artificial Sequence
  Description of Artificial Sequence: Synthetic oligonucleotide
  Description of Combined DNA/RNA Molecule: Synthetic oligonucleotide
gaaaaccguaaaggaaauctt

SEQ ID NO: 1203 - DNA, 21 bp, Artificial Sequence
  Description of Artificial Sequence: Synthetic oligonucleotide
  Description of Combined DNA/RNA Molecule: Synthetic oligonucleotide
gauuuccuuuacgguuuuctt

SEQ ID NO: 1204 - DNA, 21 bp, Artificial Sequence
  Description of Artificial Sequence: Synthetic oligonucleotide
  Description of Combined DNA/RNA Molecule: Synthetic oligonucleotide
cggccggagucccgagcuatt

SEQ ID NO: 1205 - DNA, 21 bp, Artificial Sequence
  Description of Artificial Sequence: Synthetic oligonucleotide
  Description of Combined DNA/RNA Molecule: Synthetic oligonucleotide
uagcucgggacuccggccgtt

SEQ ID NO: 1206 - DNA, 21 bp, Artificial Sequence
  Description of Artificial Sequence: Synthetic oligonucleotide
  Description of Combined DNA/RNA Molecule: Synthetic oligonucleotide
ccggagucccgagcuagcctt

SEQ ID NO: 1207 - DNA, 21 bp, Artificial Sequence
  Description of Artificial Sequence: Synthetic oligonucleotide
  Description of Combined DNA/RNA Molecule: Synthetic oligonucleotide
ggcuagcucgggacuccggtt

SEQ ID NO: 1208 - DNA, 21 bp, Artificial Sequence
  Description of Artificial Sequence: Synthetic oligonucleotide
  Description of Combined DNA/RNA Molecule: Synthetic oligonucleotide
cggagucccgagcuagccctt

SEQ ID NO: 1209 - DNA, 21 bp, Artificial Sequence
  Description of Artificial Sequence: Synthetic oligonucleotide
  Description of Combined DNA/RNA Molecule: Synthetic oligonucleotide
gggcuagcucgggacuccgtt

SEQ ID NO: 1210 - DNA, 21 bp, Artificial Sequence
  Description of Artificial Sequence: Synthetic oligonucleotide
  Description of Combined DNA/RNA Molecule: Synthetic oligonucleotide
ggagucccgagcuagcccctt

SEQ ID NO: 1211 - DNA, 21 bp, Artificial Sequence
  Description of Artificial Sequence: Synthetic oligonucleotide
  Description of Combined DNA/RNA Molecule: Synthetic oligonucleotide
ggggcuagcucgggacucctt

SEQ ID NO: 1212 - DNA, 21 bp, Artificial Sequence
  Description of Artificial Sequence: Synthetic oligonucleotide
  Description of Combined DNA/RNA Molecule: Synthetic oligonucleotide
gagucccgagcuagccccgtt

SEQ ID NO: 1213 - DNA, 21 bp, Artificial Sequence
  Description of Artificial Sequence: Synthetic oligonucleotide
  Description of Combined DNA/RNA Molecule: Synthetic oligonucleotide
cggggcuagcucgggacuctt

SEQ ID NO: 1214 - DNA, 21 bp, Artificial Sequence
  Description of Artificial Sequence: Synthetic oligonucleotide
  Description of Combined DNA/RNA Molecule: Synthetic oligonucleotide
agucccgagcuagccccggtt

SEQ ID NO: 1215 - DNA, 21 bp, Artificial Sequence
  Description of Artificial Sequence: Synthetic oligonucleotide
  Description of Combined DNA/RNA Molecule: Synthetic oligonucleotide
ccggggcuagcucgggacutt

SEQ ID NO: 1216 - DNA, 21 bp, Artificial Sequence
  Description of Artificial Sequence: Synthetic oligonucleotide
  Description of Combined DNA/RNA Molecule: Synthetic oligonucleotide
gucccgagcuagccccggctt

SEQ ID NO: 1217 - DNA, 21 bp, Artificial Sequence
  Description of Artificial Sequence: Synthetic oligonucleotide
  Description of Combined DNA/RNA Molecule: Synthetic oligonucleotide
gccggggcuagcucgggactt

SEQ ID NO: 1218 - DNA, 21 bp, Artificial Sequence
  Description of Artificial Sequence: Synthetic oligonucleotide
  Description of Combined DNA/RNA Molecule: Synthetic oligonucleotide
cccgagcuagccccggcggtt

SEQ ID NO: 1219 - DNA, 21 bp, Artificial Sequence
  Description of Artificial Sequence: Synthetic oligonucleotide
  Description of Combined DNA/RNA Molecule: Synthetic oligonucleotide
ccgccggggcuagcucgggtt

SEQ ID NO: 1220 - DNA, 21 bp, Artificial Sequence
  Description of Artificial Sequence: Synthetic oligonucleotide
  Description of Combined DNA/RNA Molecule: Synthetic oligonucleotide
ggacgacaggccaccucgutt

SEQ ID NO: 1221 - DNA, 21 bp, Artificial Sequence
  Description of Artificial Sequence: Synthetic oligonucleotide
  Description of Combined DNA/RNA Molecule: Synthetic oligonucleotide
acgagguggccugucgucctt

SEQ ID NO: 1222 - DNA, 21 bp, Artificial Sequence
  Description of Artificial Sequence: Synthetic oligonucleotide
  Description of Combined DNA/RNA Molecule: Synthetic oligonucleotide
gacgacaggccaccucguctt

SEQ ID NO: 1223 - DNA, 21 bp, Artificial Sequence
  Description of Artificial Sequence: Synthetic oligonucleotide
  Description of Combined DNA/RNA Molecule: Synthetic oligonucleotide
gacgagguggccugucguctt

SEQ ID NO: 1224 - DNA, 21 bp, Artificial Sequence
  Description of Artificial Sequence: Synthetic oligonucleotide
  Description of Combined DNA/RNA Molecule: Synthetic oligonucleotide
acgacaggccaccucgucgtt

SEQ ID NO: 1225 - DNA, 21 bp, Artificial Sequence
  Description of Artificial Sequence: Synthetic oligonucleotide
  Description of Combined DNA/RNA Molecule: Synthetic oligonucleotide
cgacgagguggccugucgutt

SEQ ID NO: 1226 - DNA, 21 bp, Artificial Sequence
  Description of Artificial Sequence: Synthetic oligonucleotide
  Description of Combined DNA/RNA Molecule: Synthetic oligonucleotide
cgacaggccaccucgucggtt

SEQ ID NO: 1227 - DNA, 21 bp, Artificial Sequence
  Description of Artificial Sequence: Synthetic oligonucleotide
  Description of Combined DNA/RNA Molecule: Synthetic oligonucleotide
ccgacgagguggccugucgtt

SEQ ID NO: 1228 - DNA, 21 bp, Artificial Sequence
  Description of Artificial Sequence: Synthetic oligonucleotide
  Description of Combined DNA/RNA Molecule: Synthetic oligonucleotide
gacaggccaccucgucggctt

SEQ ID NO: 1229 - DNA, 21 bp, Artificial Sequence
  Description of Artificial Sequence: Synthetic oligonucleotide
  Description of Combined DNA/RNA Molecule: Synthetic oligonucleotide
gccgacgagguggccuguctt

SEQ ID NO: 1230 - DNA, 21 bp, Artificial Sequence
  Description of Artificial Sequence: Synthetic oligonucleotide
  Description of Combined DNA/RNA Molecule: Synthetic oligonucleotide
caggccaccucgucggcgutt

SEQ ID NO: 1231 - DNA, 21 bp, Artificial Sequence
  Description of Artificial Sequence: Synthetic oligonucleotide
  Description of Combined DNA/RNA Molecule: Synthetic oligonucleotide
acgccgacgagguggccugtt

SEQ ID NO: 1232 - DNA, 21 bp, Artificial Sequence
  Description of Artificial Sequence: Synthetic oligonucleotide
  Description of Combined DNA/RNA Molecule: Synthetic oligonucleotide
aggccaccucgucggcguctt

SEQ ID NO: 1233 - DNA, 21 bp, Artificial Sequence
  Description of Artificial Sequence: Synthetic oligonucleotide
  Description of Combined DNA/RNA Molecule: Synthetic oligonucleotide
gacgccgacgagguggccutt

SEQ ID NO: 1234 - DNA, 21 bp, Artificial Sequence
  Description of Artificial Sequence: Synthetic oligonucleotide
  Description of Combined DNA/RNA Molecule: Synthetic oligonucleotide
ggccaccucgucggcgucctt

SEQ ID NO: 1235 - DNA, 21 bp, Artificial Sequence
  Description of Artificial Sequence: Synthetic oligonucleotide
  Description of Combined DNA/RNA Molecule: Synthetic oligonucleotide
ggacgccgacgagguggcctt

SEQ ID NO: 1236 - DNA, 21 bp, Artificial Sequence
  Description of Artificial Sequence: Synthetic oligonucleotide
  Description of Combined DNA/RNA Molecule: Synthetic oligonucleotide
gccaccucgucggcguccgtt

SEQ ID NO: 1237 - DNA, 21 bp, Artificial Sequence
  Description of Artificial Sequence: Synthetic oligonucleotide
  Description of Combined DNA/RNA Molecule: Synthetic oligonucleotide
cggacgccgacgagguggctt

SEQ ID NO: 1238 - DNA, 21 bp, Artificial Sequence
  Description of Artificial Sequence: Synthetic oligonucleotide
  Description of Combined DNA/RNA Molecule: Synthetic oligonucleotide
ccaccucgucggcguccgctt

SEQ ID NO: 1239 - DNA, 21 bp, Artificial Sequence
  Description of Artificial Sequence: Synthetic oligonucleotide
  Description of Combined DNA/RNA Molecule: Synthetic oligonucleotide
gcggacgccgacgagguggtt

SEQ ID NO: 1240 - DNA, 21 bp, Artificial Sequence
  Description of Artificial Sequence: Synthetic oligonucleotide
  Description of Combined DNA/RNA Molecule: Synthetic oligonucleotide
caccucgucggcguccgcctt

SEQ ID NO: 1241 - DNA, 21 bp, Artificial Sequence
  Description of Artificial Sequence: Synthetic oligonucleotide
  Description of Combined DNA/RNA Molecule: Synthetic oligonucleotide
ggcggacgccgacgaggugtt

SEQ ID NO: 1242 - DNA, 21 bp, Artificial Sequence
  Description of Artificial Sequence: Synthetic oligonucleotide
  Description of Combined DNA/RNA Molecule: Synthetic oligonucleotide
accucgucggcguccgccctt

SEQ ID NO: 1243 - DNA, 21 bp, Artificial Sequence
  Description of Artificial Sequence: Synthetic oligonucleotide
  Description of Combined DNA/RNA Molecule: Synthetic oligonucleotide
gggcggacgccgacgaggutt

SEQ ID NO: 1244 - DNA, 21 bp, Artificial Sequence
  Description of Artificial Sequence: Synthetic oligonucleotide
  Description of Combined DNA/RNA Molecule: Synthetic oligonucleotide
ccucgucggcguccgcccgtt

SEQ ID NO: 1245 - DNA, 21 bp, Artificial Sequence
  Description of Artificial Sequence: Synthetic oligonucleotide
  Description of Combined DNA/RNA Molecule: Synthetic oligonucleotide
cgggcggacgccgacgaggtt

SEQ ID NO: 1246 - DNA, 21 bp, Artificial Sequence
  Description of Artificial Sequence: Synthetic oligonucleotide
  Description of Combined DNA/RNA Molecule: Synthetic oligonucleotide
cucgucggcguccgcccgatt

SEQ ID NO: 1247 - DNA, 21 bp, Artificial Sequence
  Description of Artificial Sequence: Synthetic oligonucleotide
  Description of Combined DNA/RNA Molecule: Synthetic oligonucleotide
ucgggcggacgccgacgagtt

SEQ ID NO: 1248 - DNA, 21 bp, Artificial Sequence
  Description of Artificial Sequence: Synthetic oligonucleotide
  Description of Combined DNA/RNA Molecule: Synthetic oligonucleotide
ucgucggcguccgcccgagtt

SEQ ID NO: 1249 - DNA, 21 bp, Artificial Sequence
  Description of Artificial Sequence: Synthetic oligonucleotide
  Description of Combined DNA/RNA Molecule: Synthetic oligonucleotide
cucgggcggacgccgacgatt

SEQ ID NO: 1250 - DNA, 21 bp, Artificial Sequence
  Description of Artificial Sequence: Synthetic oligonucleotide
  Description of Combined DNA/RNA Molecule: Synthetic oligonucleotide
cgucggcguccgcccgagutt

SEQ ID NO: 1251 - DNA, 21 bp, Artificial Sequence
  Description of Artificial Sequence: Synthetic oligonucleotide
  Description of Combined DNA/RNA Molecule: Synthetic oligonucleotide
acucgggcggacgccgacgtt

SEQ ID NO: 1252 - DNA, 21 bp, Artificial Sequence
  Description of Artificial Sequence: Synthetic oligonucleotide
  Description of Combined DNA/RNA Molecule: Synthetic oligonucleotide
gucggcguccgcccgaguctt

SEQ ID NO: 1253 - DNA, 21 bp, Artificial Sequence
  Description of Artificial Sequence: Synthetic oligonucleotide
  Description of Combined DNA/RNA Molecule: Synthetic oligonucleotide
gacucgggcggacgccgactt

SEQ ID NO: 1254 - DNA, 21 bp, Artificial Sequence
  Description of Artificial Sequence: Synthetic oligonucleotide
  Description of Combined DNA/RNA Molecule: Synthetic oligonucleotide
ucggcguccgcccgagucctt

SEQ ID NO: 1255 - DNA, 21 bp, Artificial Sequence
  Description of Artificial Sequence: Synthetic oligonucleotide
  Description of Combined DNA/RNA Molecule: Synthetic oligonucleotide
ggacucgggcggacgccgatt

SEQ ID NO: 1256 - DNA, 21 bp, Artificial Sequence
  Description of Artificial Sequence: Synthetic oligonucleotide
  Description of Combined DNA/RNA Molecule: Synthetic oligonucleotide
gcguccgcccgaguccccgtt

SEQ ID NO: 1257 - DNA, 21 bp, Artificial Sequence
  Description of Artificial Sequence: Synthetic oligonucleotide
  Description of Combined DNA/RNA Molecule: Synthetic oligonucleotide
cggggacucgggcggacgctt

SEQ ID NO: 1258 - DNA, 21 bp, Artificial Sequence
  Description of Artificial Sequence: Synthetic oligonucleotide
  Description of Combined DNA/RNA Molecule: Synthetic oligonucleotide
cguccgcccgaguccccgctt

SEQ ID NO: 1259 - DNA, 21 bp, Artificial Sequence
  Description of Artificial Sequence: Synthetic oligonucleotide
  Description of Combined DNA/RNA Molecule: Synthetic oligonucleotide
gcggggacucgggcggacgtt

SEQ ID NO: 1260 - DNA, 21 bp, Artificial Sequence
  Description of Artificial Sequence: Synthetic oligonucleotide
  Description of Combined DNA/RNA Molecule: Synthetic oligonucleotide
gcccgaguccccgccucgctt

SEQ ID NO: 1261 - DNA, 21 bp, Artificial Sequence
  Description of Artificial Sequence: Synthetic oligonucleotide
  Description of Combined DNA/RNA Molecule: Synthetic oligonucleotide
gcgaggcggggacucgggctt

SEQ ID NO: 1262 - DNA, 21 bp, Artificial Sequence
  Description of Artificial Sequence: Synthetic oligonucleotide
  Description of Combined DNA/RNA Molecule: Synthetic oligonucleotide
aacgccacaaccaccgcgctt

SEQ ID NO: 1263 - DNA, 21 bp, Artificial Sequence
  Description of Artificial Sequence: Synthetic oligonucleotide
  Description of Combined DNA/RNA Molecule: Synthetic oligonucleotide
gcgcggugguuguggcguutt

SEQ ID NO: 1264 - DNA, 21 bp, Artificial Sequence
  Description of Artificial Sequence: Synthetic oligonucleotide
  Description of Combined DNA/RNA Molecule: Synthetic oligonucleotide
acgccacaaccaccgcgcatt

SEQ ID NO: 1265 - DNA, 21 bp, Artificial Sequence
  Description of Artificial Sequence: Synthetic oligonucleotide
  Description of Combined DNA/RNA Molecule: Synthetic oligonucleotide
ugcgcggugguuguggcgutt

SEQ ID NO: 1266 - DNA, 21 bp, Artificial Sequence
  Description of Artificial Sequence: Synthetic oligonucleotide
  Description of Combined DNA/RNA Molecule: Synthetic oligonucleotide
cgccacaaccaccgcgcactt

SEQ ID NO: 1267 - DNA, 21 bp, Artificial Sequence
  Description of Artificial Sequence: Synthetic oligonucleotide
  Description of Combined DNA/RNA Molecule: Synthetic oligonucleotide
gugcgcggugguuguggcgtt

SEQ ID NO: 1268 - DNA, 21 bp, Artificial Sequence
  Description of Artificial Sequence: Synthetic oligonucleotide
  Description of Combined DNA/RNA Molecule: Synthetic oligonucleotide
ccacaaccaccgcgcacggtt

SEQ ID NO: 1269 - DNA, 21 bp, Artificial Sequence
  Description of Artificial Sequence: Synthetic oligonucleotide
  Description of Combined DNA/RNA Molecule: Synthetic oligonucleotide
ccgugcgcggugguuguggtt

SEQ ID NO: 1270 - DNA, 21 bp, Artificial Sequence
  Description of Artificial Sequence: Synthetic oligonucleotide
  Description of Combined DNA/RNA Molecule: Synthetic oligonucleotide
cacaaccaccgcgcacggctt

SEQ ID NO: 1271 - DNA, 21 bp, Artificial Sequence
  Description of Artificial Sequence: Synthetic oligonucleotide
  Description of Combined DNA/RNA Molecule: Synthetic oligonucleotide
gccgugcgcggugguugugtt

SEQ ID NO: 1272 - DNA, 21 bp, Artificial Sequence
  Description of Artificial Sequence: Synthetic oligonucleotide
  Description of Combined DNA/RNA Molecule: Synthetic oligonucleotide
acaaccaccgcgcacggcctt

SEQ ID NO: 1273 - DNA, 21 bp, Artificial Sequence
  Description of Artificial Sequence: Synthetic oligonucleotide
  Description of Combined DNA/RNA Molecule: Synthetic oligonucleotide
ggccgugcgcggugguugutt

SEQ ID NO: 1274 - DNA, 21 bp, Artificial Sequence
  Description of Artificial Sequence: Synthetic oligonucleotide
  Description of Combined DNA/RNA Molecule: Synthetic oligonucleotide
augcgacccuccgggacggtt

SEQ ID NO: 1275 - DNA, 21 bp, Artificial Sequence
  Description of Artificial Sequence: Synthetic oligonucleotide
  Description of Combined DNA/RNA Molecule: Synthetic oligonucleotide
ccgucccggagggucgcautt

SEQ ID NO: 1276 - DNA, 21 bp, Artificial Sequence
  Description of Artificial Sequence: Synthetic oligonucleotide
  Description of Combined DNA/RNA Molecule: Synthetic oligonucleotide
ugcgacccuccgggacggctt

SEQ ID NO: 1277 - DNA, 21 bp, Artificial Sequence
  Description of Artificial Sequence: Synthetic oligonucleotide
  Description of Combined DNA/RNA Molecule: Synthetic oligonucleotide
gccgucccggagggucgcatt

SEQ ID NO: 1278 - DNA, 21 bp, Artificial Sequence
  Description of Artificial Sequence: Synthetic oligonucleotide
  Description of Combined DNA/RNA Molecule: Synthetic oligonucleotide
gcgacccuccgggacggcctt

SEQ ID NO: 1279 - DNA, 21 bp, Artificial Sequence
  Description of Artificial Sequence: Synthetic oligonucleotide
  Description of Combined DNA/RNA Molecule: Synthetic oligonucleotide
ggccgucccggagggucgctt

SEQ ID NO: 1280 - DNA, 21 bp, Artificial Sequence
  Description of Artificial Sequence: Synthetic oligonucleotide
  Description of Combined DNA/RNA Molecule: Synthetic oligonucleotide
gacccuccgggacggccggtt

SEQ ID NO: 1281 - DNA, 21 bp, Artificial Sequence
  Description of Artificial Sequence: Synthetic oligonucleotide
  Description of Combined DNA/RNA Molecule: Synthetic oligonucleotide
ccggccgucccggaggguctt

SEQ ID NO: 1282 - DNA, 21 bp, Artificial Sequence
  Description of Artificial Sequence: Synthetic oligonucleotide
  Description of Combined DNA/RNA Molecule: Synthetic oligonucleotide
acccuccgggacggccgggtt

SEQ ID NO: 1283 - DNA, 21 bp, Artificial Sequence
  Description of Artificial Sequence: Synthetic oligonucleotide
  Description of Combined DNA/RNA Molecule: Synthetic oligonucleotide
cccggccgucccggagggutt

SEQ ID NO: 1284 - DNA, 21 bp, Artificial Sequence
  Description of Artificial Sequence: Synthetic oligonucleotide
  Description of Combined DNA/RNA Molecule: Synthetic oligonucleotide
ccuccgggacggccggggctt

SEQ ID NO: 1285 - DNA, 21 bp, Artificial Sequence
  Description of Artificial Sequence: Synthetic oligonucleotide
  Description of Combined DNA/RNA Molecule: Synthetic oligonucleotide
gccccggccgucccggaggtt

SEQ ID NO: 1286 - DNA, 21 bp, Artificial Sequence
  Description of Artificial Sequence: Synthetic oligonucleotide
  Description of Combined DNA/RNA Molecule: Synthetic oligonucleotide
agaaaguuugccaaggcactt

SEQ ID NO: 1287 - DNA, 21 bp, Artificial Sequence
  Description of Artificial Sequence: Synthetic oligonucleotide
  Description of Combined DNA/RNA Molecule: Synthetic oligonucleotide
gugccuuggcaaacuuucutt

SEQ ID NO: 1288 - DNA, 21 bp, Artificial Sequence
  Description of Artificial Sequence: Synthetic oligonucleotide
  Description of Combined DNA/RNA Molecule: Synthetic oligonucleotide
gaaaguuugccaaggcacgtt

SEQ ID NO: 1289 - DNA, 21 bp, Artificial Sequence
  Description of Artificial Sequence: Synthetic oligonucleotide
  Description of Combined DNA/RNA Molecule: Synthetic oligonucleotide
cgugccuuggcaaacuuuctt

SEQ ID NO: 1290 - DNA, 21 bp, Artificial Sequence
  Description of Artificial Sequence: Synthetic oligonucleotide
  Description of Combined DNA/RNA Molecule: Synthetic oligonucleotide
aaguuugccaaggcacgagtt

SEQ ID NO: 1291 - DNA, 21 bp, Artificial Sequence
  Description of Artificial Sequence: Synthetic oligonucleotide
  Description of Combined DNA/RNA Molecule: Synthetic oligonucleotide
cucgugccuuggcaaacuutt

SEQ ID NO: 1292 - DNA, 21 bp, Artificial Sequence
  Description of Artificial Sequence: Synthetic oligonucleotide
  Description of Combined DNA/RNA Molecule: Synthetic oligonucleotide
aguuugccaaggcacgagutt

SEQ ID NO: 1293 - DNA, 21 bp, Artificial Sequence
  Description of Artificial Sequence: Synthetic oligonucleotide
  Description of Combined DNA/RNA Molecule: Synthetic oligonucleotide
acucgugccuuggcaaacutt

SEQ ID NO: 1294 - DNA, 21 bp, Artificial Sequence
  Description of Artificial Sequence: Synthetic oligonucleotide
  Description of Combined DNA/RNA Molecule: Synthetic oligonucleotide
guuugccaaggcacgaguatt

SEQ ID NO: 1295 - DNA, 21 bp, Artificial Sequence
  Description of Artificial Sequence: Synthetic oligonucleotide
  Description of Combined DNA/RNA Molecule: Synthetic oligonucleotide
uacucgugccuuggcaaactt

SEQ ID NO: 1296 - DNA, 21 bp, Artificial Sequence
  Description of Artificial Sequence: Synthetic oligonucleotide
  Description of Combined DNA/RNA Molecule: Synthetic oligonucleotide
uuugccaaggcacgaguaatt

SEQ ID NO: 1297 - DNA, 21 bp, Artificial Sequence
  Description of Artificial Sequence: Synthetic oligonucleotide
  Description of Combined DNA/RNA Molecule: Synthetic oligonucleotide
uuacucgugccuuggcaaatt

SEQ ID NO: 1298 - DNA, 21 bp, Artificial Sequence
  Description of Artificial Sequence: Synthetic oligonucleotide
  Description of Combined DNA/RNA Molecule: Synthetic oligonucleotide
uugccaaggcacgaguaactt

SEQ ID NO: 1299 - DNA, 21 bp, Artificial Sequence
  Description of Artificial Sequence: Synthetic oligonucleotide
  Description of Combined DNA/RNA Molecule: Synthetic oligonucleotide
guuacucgugccuuggcaatt

SEQ ID NO: 1300 - DNA, 21 bp, Artificial Sequence
  Description of Artificial Sequence: Synthetic oligonucleotide
  Description of Combined DNA/RNA Molecule: Synthetic oligonucleotide
ugccaaggcacgaguaacatt

SEQ ID NO: 1301 - DNA, 21 bp, Artificial Sequence
  Description of Artificial Sequence: Synthetic oligonucleotide
  Description of Combined DNA/RNA Molecule: Synthetic oligonucleotide
uguuacucgugccuuggcatt

SEQ ID NO: 1302 - DNA, 21 bp, Artificial Sequence
  Description of Artificial Sequence: Synthetic oligonucleotide
  Description of Combined DNA/RNA Molecule: Synthetic oligonucleotide
gccaaggcacgaguaacaatt

SEQ ID NO: 1303 - DNA, 21 bp, Artificial Sequence
  Description of Artificial Sequence: Synthetic oligonucleotide
  Description of Combined DNA/RNA Molecule: Synthetic oligonucleotide
uuguuacucgugccuuggctt

SEQ ID NO: 1304 - DNA, 21 bp, Artificial Sequence
  Description of Artificial Sequence: Synthetic oligonucleotide
  Description of Combined DNA/RNA Molecule: Synthetic oligonucleotide
acgcaguugggcacuuuugtt

SEQ ID NO: 1305 - DNA, 21 bp, Artificial Sequence
  Description of Artificial Sequence: Synthetic oligonucleotide
  Description of Combined DNA/RNA Molecule: Synthetic oligonucleotide
caaaagugcccaacugcgutt

SEQ ID NO: 1306 - DNA, 21 bp, Artificial Sequence
  Description of Artificial Sequence: Synthetic oligonucleotide
  Description of Combined DNA/RNA Molecule: Synthetic oligonucleotide
cgcaguugggcacuuuugatt

SEQ ID NO: 1307 - DNA, 21 bp, Artificial Sequence
  Description of Artificial Sequence: Synthetic oligonucleotide
  Description of Combined DNA/RNA Molecule: Synthetic oligonucleotide
ucaaaagugcccaacugcgtt

SEQ ID NO: 1308 - DNA, 21 bp, Artificial Sequence
  Description of Artificial Sequence: Synthetic oligonucleotide
  Description of Combined DNA/RNA Molecule: Synthetic oligonucleotide
gcaguugggcacuuuugaatt

SEQ ID NO: 1309 - DNA, 21 bp, Artificial Sequence
  Description of Artificial Sequence: Synthetic oligonucleotide
  Description of Combined DNA/RNA Molecule: Synthetic oligonucleotide
uucaaaagugcccaacugctt

SEQ ID NO: 1310 - DNA, 21 bp, Artificial Sequence
  Description of Artificial Sequence: Synthetic oligonucleotide
  Description of Combined DNA/RNA Molecule: Synthetic oligonucleotide
caguugggcacuuuugaagtt

SEQ ID NO: 1311 - DNA, 21 bp, Artificial Sequence
  Description of Artificial Sequence: Synthetic oligonucleotide
  Description of Combined DNA/RNA Molecule: Synthetic oligonucleotide
cuucaaaagugcccaacugtt

SEQ ID NO: 1312 - DNA, 21 bp, Artificial Sequence
  Description of Artificial Sequence: Synthetic oligonucleotide
  Description of Combined DNA/RNA Molecule: Synthetic oligonucleotide
aguugggcacuuuugaagatt

SEQ ID NO: 1313 - DNA, 21 bp, Artificial Sequence
  Description of Artificial Sequence: Synthetic oligonucleotide
  Description of Combined DNA/RNA Molecule: Synthetic oligonucleotide
ucuucaaaagugcccaacutt

SEQ ID NO: 1314 - DNA, 21 bp, Artificial Sequence
  Description of Artificial Sequence: Synthetic oligonucleotide
  Description of Combined DNA/RNA Molecule: Synthetic oligonucleotide
guugggcacuuuugaagautt

SEQ ID NO: 1315 - DNA, 21 bp, Artificial Sequence
  Description of Artificial Sequence: Synthetic oligonucleotide
  Description of Combined DNA/RNA Molecule: Synthetic oligonucleotide
aucuucaaaagugcccaactt

SEQ ID NO: 1316 - DNA, 21 bp, Artificial Sequence
  Description of Artificial Sequence: Synthetic oligonucleotide
  Description of Combined DNA/RNA Molecule: Synthetic oligonucleotide
uugggcacuuuugaagauctt

SEQ ID NO: 1317 - DNA, 21 bp, Artificial Sequence
  Description of Artificial Sequence: Synthetic oligonucleotide
  Description of Combined DNA/RNA Molecule: Synthetic oligonucleotide
gaucuucaaaagugcccaatt

SEQ ID NO: 1318 - DNA, 21 bp, Artificial Sequence
  Description of Artificial Sequence: Synthetic oligonucleotide
  Description of Combined DNA/RNA Molecule: Synthetic oligonucleotide
ugggcacuuuugaagaucatt

SEQ ID NO: 1319 - DNA, 21 bp, Artificial Sequence
  Description of Artificial Sequence: Synthetic oligonucleotide
  Description of Combined DNA/RNA Molecule: Synthetic oligonucleotide
ugaucuucaaaagugcccatt

SEQ ID NO: 1320 - DNA, 21 bp, Artificial Sequence
  Description of Artificial Sequence: Synthetic oligonucleotide
  Description of Combined DNA/RNA Molecule: Synthetic oligonucleotide
gggcacuuuugaagaucautt

SEQ ID NO: 1321 - DNA, 21 bp, Artificial Sequence
  Description of Artificial Sequence: Synthetic oligonucleotide
  Description of Combined DNA/RNA Molecule: Synthetic oligonucleotide
augaucuucaaaagugccctt

SEQ ID NO: 1322 - DNA, 21 bp, Artificial Sequence
  Description of Artificial Sequence: Synthetic oligonucleotide
  Description of Combined DNA/RNA Molecule: Synthetic oligonucleotide
uugaagaucauuuucucagtt

SEQ ID NO: 1323 - DNA, 21 bp, Artificial Sequence
  Description of Artificial Sequence: Synthetic oligonucleotide
  Description of Combined DNA/RNA Molecule: Synthetic oligonucleotide
cugagaaaaugaucuucaatt

SEQ ID NO: 1324 - DNA, 21 bp, Artificial Sequence
  Description of Artificial Sequence: Synthetic oligonucleotide
  Description of Combined DNA/RNA Molecule: Synthetic oligonucleotide
gaagaucauuuucucagcctt

SEQ ID NO: 1325 - DNA, 21 bp, Artificial Sequence
  Description of Artificial Sequence: Synthetic oligonucleotide
  Description of Combined DNA/RNA Molecule: Synthetic oligonucleotide
ggcugagaaaaugaucuuctt

SEQ ID NO: 1326 - DNA, 21 bp, Artificial Sequence
  Description of Artificial Sequence: Synthetic oligonucleotide
  Description of Combined DNA/RNA Molecule: Synthetic oligonucleotide
aagaucauuuucucagccutt

SEQ ID NO: 1327 - DNA, 21 bp, Artificial Sequence
  Description of Artificial Sequence: Synthetic oligonucleotide
  Description of Combined DNA/RNA Molecule: Synthetic oligonucleotide
aggcugagaaaaugaucuutt

SEQ ID NO: 1328 - DNA, 21 bp, Artificial Sequence
  Description of Artificial Sequence: Synthetic oligonucleotide
  Description of Combined DNA/RNA Molecule: Synthetic oligonucleotide
cauuuucucagccuccagatt

SEQ ID NO: 1329 - DNA, 21 bp, Artificial Sequence
  Description of Artificial Sequence: Synthetic oligonucleotide
  Description of Combined DNA/RNA Molecule: Synthetic oligonucleotide
ucuggaggcugagaaaaugtt

SEQ ID NO: 1330 - DNA, 21 bp, Artificial Sequence
  Description of Artificial Sequence: Synthetic oligonucleotide
  Description of Combined DNA/RNA Molecule: Synthetic oligonucleotide
agccuccagaggauguucatt

SEQ ID NO: 1331 - DNA, 21 bp, Artificial Sequence
  Description of Artificial Sequence: Synthetic oligonucleotide
  Description of Combined DNA/RNA Molecule: Synthetic oligonucleotide
ugaacauccucuggaggcutt

SEQ ID NO: 1332 - DNA, 21 bp, Artificial Sequence
  Description of Artificial Sequence: Synthetic oligonucleotide
  Description of Combined DNA/RNA Molecule: Synthetic oligonucleotide
ccuccagaggauguucaautt

SEQ ID NO: 1333 - DNA, 21 bp, Artificial Sequence
  Description of Artificial Sequence: Synthetic oligonucleotide
  Description of Combined DNA/RNA Molecule: Synthetic oligonucleotide
auugaacauccucuggaggtt

SEQ ID NO: 1334 - DNA, 21 bp, Artificial Sequence
  Description of Artificial Sequence: Synthetic oligonucleotide
  Description of Combined DNA/RNA Molecule: Synthetic oligonucleotide
cuccagaggauguucaauatt

SEQ ID NO: 1335 - DNA, 21 bp, Artificial Sequence
  Description of Artificial Sequence: Synthetic oligonucleotide
  Description of Combined DNA/RNA Molecule: Synthetic oligonucleotide
uauugaacauccucuggagtt

SEQ ID NO: 1336 - DNA, 21 bp, Artificial Sequence
  Description of Artificial Sequence: Synthetic oligonucleotide
  Description of Combined DNA/RNA Molecule: Synthetic oligonucleotide
agaggauguucaauaacugtt

SEQ ID NO: 1337 - DNA, 21 bp, Artificial Sequence
  Description of Artificial Sequence: Synthetic oligonucleotide
  Description of Combined DNA/RNA Molecule: Synthetic oligonucleotide
caguuauugaacauccucutt

SEQ ID NO: 1338 - DNA, 21 bp, Artificial Sequence
  Description of Artificial Sequence: Synthetic oligonucleotide
  Description of Combined DNA/RNA Molecule: Synthetic oligonucleotide
aggauguucaauaacugugtt

SEQ ID NO: 1339 - DNA, 21 bp, Artificial Sequence
  Description of Artificial Sequence: Synthetic oligonucleotide
  Description of Combined DNA/RNA Molecule: Synthetic oligonucleotide
cacaguuauugaacauccutt

SEQ ID NO: 1340 - DNA, 21 bp, Artificial Sequence
  Description of Artificial Sequence: Synthetic oligonucleotide
  Description of Combined DNA/RNA Molecule: Synthetic oligonucleotide
uguucaauaacugugaggutt

SEQ ID NO: 1341 - DNA, 21 bp, Artificial Sequence
  Description of Artificial Sequence: Synthetic oligonucleotide
  Description of Combined DNA/RNA Molecule: Synthetic oligonucleotide
accucacaguuauugaacatt

SEQ ID NO: 1342 - DNA, 21 bp, Artificial Sequence
  Description of Artificial Sequence: Synthetic oligonucleotide
  Description of Combined DNA/RNA Molecule: Synthetic oligonucleotide
uucaauaacugugagguggtt

SEQ ID NO: 1343 - DNA, 21 bp, Artificial Sequence
  Description of Artificial Sequence: Synthetic oligonucleotide
  Description of Combined DNA/RNA Molecule: Synthetic oligonucleotide
ccaccucacaguuauugaatt

SEQ ID NO: 1344 - DNA, 21 bp, Artificial Sequence
  Description of Artificial Sequence: Synthetic oligonucleotide
  Description of Combined DNA/RNA Molecule: Synthetic oligonucleotide
ucaauaacugugagguggutt

SEQ ID NO: 1345 - DNA, 21 bp, Artificial Sequence
  Description of Artificial Sequence: Synthetic oligonucleotide
  Description of Combined DNA/RNA Molecule: Synthetic oligonucleotide
accaccucacaguuauugatt

SEQ ID NO: 1346 - DNA, 21 bp, Artificial Sequence
  Description of Artificial Sequence: Synthetic oligonucleotide
  Description of Combined DNA/RNA Molecule: Synthetic oligonucleotide
caauaacugugaggugguctt

SEQ ID NO: 1347 - DNA, 21 bp, Artificial Sequence
  Description of Artificial Sequence: Synthetic oligonucleotide
  Description of Combined DNA/RNA Molecule: Synthetic oligonucleotide
gaccaccucacaguuauugtt

SEQ ID NO: 1348 - DNA, 21 bp, Artificial Sequence
  Description of Artificial Sequence: Synthetic oligonucleotide
  Description of Combined DNA/RNA Molecule: Synthetic oligonucleotide
aauaacugugagguggucctt

SEQ ID NO: 1349 - DNA, 21 bp, Artificial Sequence
  Description of Artificial Sequence: Synthetic oligonucleotide
  Description of Combined DNA/RNA Molecule: Synthetic oligonucleotide
ggaccaccucacaguuauutt

SEQ ID NO: 1350 - DNA, 21 bp, Artificial Sequence
  Description of Artificial Sequence: Synthetic oligonucleotide
  Description of Combined DNA/RNA Molecule: Synthetic oligonucleotide
auaacugugaggugguccutt

SEQ ID NO: 1351 - DNA, 21 bp, Artificial Sequence
  Description of Artificial Sequence: Synthetic oligonucleotide
  Description of Combined DNA/RNA Molecule: Synthetic oligonucleotide
aggaccaccucacaguuautt

SEQ ID NO: 1352 - DNA, 21 bp, Artificial Sequence
  Description of Artificial Sequence: Synthetic oligonucleotide
  Description of Combined DNA/RNA Molecule: Synthetic oligonucleotide
uaacugugaggugguccuutt

SEQ ID NO: 1353 - DNA, 21 bp, Artificial Sequence
  Description of Artificial Sequence: Synthetic oligonucleotide
  Description of Combined DNA/RNA Molecule: Synthetic oligonucleotide
aaggaccaccucacaguuatt

SEQ ID NO: 1354 - DNA, 21 bp, Artificial Sequence
  Description of Artificial Sequence: Synthetic oligonucleotide
  Description of Combined DNA/RNA Molecule: Synthetic oligonucleotide
acugugaggugguccuuggtt

SEQ ID NO: 1355 - DNA, 21 bp, Artificial Sequence
  Description of Artificial Sequence: Synthetic oligonucleotide
  Description of Combined DNA/RNA Molecule: Synthetic oligonucleotide
ccaaggaccaccucacagutt

SEQ ID NO: 1356 - DNA, 21 bp, Artificial Sequence
  Description of Artificial Sequence: Synthetic oligonucleotide
  Description of Combined DNA/RNA Molecule: Synthetic oligonucleotide
ugugaggugguccuugggatt

SEQ ID NO: 1357 - DNA, 21 bp, Artificial Sequence
  Description of Artificial Sequence: Synthetic oligonucleotide
  Description of Combined DNA/RNA Molecule: Synthetic oligonucleotide
ucccaaggaccaccucacatt

SEQ ID NO: 1358 - DNA, 21 bp, Artificial Sequence
  Description of Artificial Sequence: Synthetic oligonucleotide
  Description of Combined DNA/RNA Molecule: Synthetic oligonucleotide
gugaggugguccuugggaatt

SEQ ID NO: 1359 - DNA, 21 bp, Artificial Sequence
  Description of Artificial Sequence: Synthetic oligonucleotide
  Description of Combined DNA/RNA Molecule: Synthetic oligonucleotide
uucccaaggaccaccucactt

SEQ ID NO: 1360 - DNA, 21 bp, Artificial Sequence
  Description of Artificial Sequence: Synthetic oligonucleotide
  Description of Combined DNA/RNA Molecule: Synthetic oligonucleotide
ugguccuugggaauuuggatt

SEQ ID NO: 1361 - DNA, 21 bp, Artificial Sequence
  Description of Artificial Sequence: Synthetic oligonucleotide
  Description of Combined DNA/RNA Molecule: Synthetic oligonucleotide
uccaaauucccaaggaccatt

SEQ ID NO: 1362 - DNA, 21 bp, Artificial Sequence
  Description of Artificial Sequence: Synthetic oligonucleotide
  Description of Combined DNA/RNA Molecule: Synthetic oligonucleotide
uugggaauuuggaaauuactt

SEQ ID NO: 1363 - DNA, 21 bp, Artificial Sequence
  Description of Artificial Sequence: Synthetic oligonucleotide
  Description of Combined DNA/RNA Molecule: Synthetic oligonucleotide
guaauuuccaaauucccaatt

SEQ ID NO: 1364 - DNA, 21 bp, Artificial Sequence
  Description of Artificial Sequence: Synthetic oligonucleotide
  Description of Combined DNA/RNA Molecule: Synthetic oligonucleotide
ugggaauuuggaaauuacctt

SEQ ID NO: 1365 - DNA, 21 bp, Artificial Sequence
  Description of Artificial Sequence: Synthetic oligonucleotide
  Description of Combined DNA/RNA Molecule: Synthetic oligonucleotide
gguaauuuccaaauucccatt

SEQ ID NO: 1366 - DNA, 21 bp, Artificial Sequence
  Description of Artificial Sequence: Synthetic oligonucleotide
  Description of Combined DNA/RNA Molecule: Synthetic oligonucleotide
gggaauuuggaaauuaccutt

SEQ ID NO: 1367 - DNA, 21 bp, Artificial Sequence
  Description of Artificial Sequence: Synthetic oligonucleotide
  Description of Combined DNA/RNA Molecule: Synthetic oligonucleotide
agguaauuuccaaauuccctt

SEQ ID NO: 1368 - DNA, 21 bp, Artificial Sequence
  Description of Artificial Sequence: Synthetic oligonucleotide
  Description of Combined DNA/RNA Molecule: Synthetic oligonucleotide
ggaauuuggaaauuaccuatt

SEQ ID NO: 1369 - DNA, 21 bp, Artificial Sequence
  Description of Artificial Sequence: Synthetic oligonucleotide
  Description of Combined DNA/RNA Molecule: Synthetic oligonucleotide
uagguaauuuccaaauucctt

SEQ ID NO: 1370 - DNA, 21 bp, Artificial Sequence
  Description of Artificial Sequence: Synthetic oligonucleotide
  Description of Combined DNA/RNA Molecule: Synthetic oligonucleotide
agaggaauuaugaucuuuctt

SEQ ID NO: 1371 - DNA, 21 bp, Artificial Sequence
  Description of Artificial Sequence: Synthetic oligonucleotide
  Description of Combined DNA/RNA Molecule: Synthetic oligonucleotide
gaaagaucauaauuccucutt

SEQ ID NO: 1372 - DNA, 21 bp, Artificial Sequence
  Description of Artificial Sequence: Synthetic oligonucleotide
  Description of Combined DNA/RNA Molecule: Synthetic oligonucleotide
gaggaauuaugaucuuucctt

SEQ ID NO: 1373 - DNA, 21 bp, Artificial Sequence
  Description of Artificial Sequence: Synthetic oligonucleotide
  Description of Combined DNA/RNA Molecule: Synthetic oligonucleotide
ggaaagaucauaauuccuctt

SEQ ID NO: 1374 - DNA, 21 bp, Artificial Sequence
  Description of Artificial Sequence: Synthetic oligonucleotide
  Description of Combined DNA/RNA Molecule: Synthetic oligonucleotide
aauuaugaucuuuccuucutt

SEQ ID NO: 1375 - DNA, 21 bp, Artificial Sequence
  Description of Artificial Sequence: Synthetic oligonucleotide
  Description of Combined DNA/RNA Molecule: Synthetic oligonucleotide
agaaggaaagaucauaauutt

SEQ ID NO: 1376 - DNA, 21 bp, Artificial Sequence
  Description of Artificial Sequence: Synthetic oligonucleotide
  Description of Combined DNA/RNA Molecule: Synthetic oligonucleotide
auuaugaucuuuccuucuutt

SEQ ID NO: 1377 - DNA, 21 bp, Artificial Sequence
  Description of Artificial Sequence: Synthetic oligonucleotide
  Description of Combined DNA/RNA Molecule: Synthetic oligonucleotide
aagaaggaaagaucauaautt

SEQ ID NO: 1378 - DNA, 21 bp, Artificial Sequence
  Description of Artificial Sequence: Synthetic oligonucleotide
  Description of Combined DNA/RNA Molecule: Synthetic oligonucleotide
uaugaucuuuccuucuuaatt

SEQ ID NO: 1379 - DNA, 21 bp, Artificial Sequence
  Description of Artificial Sequence: Synthetic oligonucleotide
  Description of Combined DNA/RNA Molecule: Synthetic oligonucleotide
uuaagaaggaaagaucauatt

SEQ ID NO: 1380 - DNA, 21 bp, Artificial Sequence
  Description of Artificial Sequence: Synthetic oligonucleotide
  Description of Combined DNA/RNA Molecule: Synthetic oligonucleotide
ugaucuuuccuucuuaaagtt

SEQ ID NO: 1381 - DNA, 21 bp, Artificial Sequence
  Description of Artificial Sequence: Synthetic oligonucleotide
  Description of Combined DNA/RNA Molecule: Synthetic oligonucleotide
cuuuaagaaggaaagaucatt

SEQ ID NO: 1382 - DNA, 21 bp, Artificial Sequence
  Description of Artificial Sequence: Synthetic oligonucleotide
  Description of Combined DNA/RNA Molecule: Synthetic oligonucleotide
ucuuuccuucuuaaagacctt

SEQ ID NO: 1383 - DNA, 21 bp, Artificial Sequence
  Description of Artificial Sequence: Synthetic oligonucleotide
  Description of Combined DNA/RNA Molecule: Synthetic oligonucleotide
ggucuuuaagaaggaaagatt

SEQ ID NO: 1384 - DNA, 21 bp, Artificial Sequence
  Description of Artificial Sequence: Synthetic oligonucleotide
  Description of Combined DNA/RNA Molecule: Synthetic oligonucleotide
ccuucuuaaagaccauccatt

SEQ ID NO: 1385 - DNA, 21 bp, Artificial Sequence
  Description of Artificial Sequence: Synthetic oligonucleotide
  Description of Combined DNA/RNA Molecule: Synthetic oligonucleotide
uggauggucuuuaagaaggtt

SEQ ID NO: 1386 - DNA, 21 bp, Artificial Sequence
  Description of Artificial Sequence: Synthetic oligonucleotide
  Description of Combined DNA/RNA Molecule: Synthetic oligonucleotide
cuucuuaaagaccauccagtt

SEQ ID NO: 1387 - DNA, 21 bp, Artificial Sequence
  Description of Artificial Sequence: Synthetic oligonucleotide
  Description of Combined DNA/RNA Molecule: Synthetic oligonucleotide
cuggauggucuuuaagaagtt

SEQ ID NO: 1388 - DNA, 21 bp, Artificial Sequence
  Description of Artificial Sequence: Synthetic oligonucleotide
  Description of Combined DNA/RNA Molecule: Synthetic oligonucleotide
ucuuaaagaccauccaggatt

SEQ ID NO: 1389 - DNA, 21 bp, Artificial Sequence
  Description of Artificial Sequence: Synthetic oligonucleotide
  Description of Combined DNA/RNA Molecule: Synthetic oligonucleotide
uccuggauggucuuuaagatt

SEQ ID NO: 1390 - DNA, 21 bp, Artificial Sequence
  Description of Artificial Sequence: Synthetic oligonucleotide
  Description of Combined DNA/RNA Molecule: Synthetic oligonucleotide
uuaaagaccauccaggaggtt

SEQ ID NO: 1391 - DNA, 21 bp, Artificial Sequence
  Description of Artificial Sequence: Synthetic oligonucleotide
  Description of Combined DNA/RNA Molecule: Synthetic oligonucleotide
ccuccuggauggucuuuaatt

SEQ ID NO: 1392 - DNA, 21 bp, Artificial Sequence
  Description of Artificial Sequence: Synthetic oligonucleotide
  Description of Combined DNA/RNA Molecule: Synthetic oligonucleotide
uaaagaccauccaggaggutt

SEQ ID NO: 1393 - DNA, 21 bp, Artificial Sequence
  Description of Artificial Sequence: Synthetic oligonucleotide
  Description of Combined DNA/RNA Molecule: Synthetic oligonucleotide
accuccuggauggucuuuatt

SEQ ID NO: 1394 - DNA, 21 bp, Artificial Sequence
  Description of Artificial Sequence: Synthetic oligonucleotide
  Description of Combined DNA/RNA Molecule: Synthetic oligonucleotide
ccaggagguggcugguuautt

SEQ ID NO: 1395 - DNA, 21 bp, Artificial Sequence
  Description of Artificial Sequence: Synthetic oligonucleotide
  Description of Combined DNA/RNA Molecule: Synthetic oligonucleotide
auaaccagccaccuccuggtt

SEQ ID NO: 1396 - DNA, 21 bp, Artificial Sequence
  Description of Artificial Sequence: Synthetic oligonucleotide
  Description of Combined DNA/RNA Molecule: Synthetic oligonucleotide
caggagguggcugguuaugtt

SEQ ID NO: 1397 - DNA, 21 bp, Artificial Sequence
  Description of Artificial Sequence: Synthetic oligonucleotide
  Description of Combined DNA/RNA Molecule: Synthetic oligonucleotide
cauaaccagccaccuccugtt

SEQ ID NO: 1398 - DNA, 21 bp, Artificial Sequence
  Description of Artificial Sequence: Synthetic oligonucleotide
  Description of Combined DNA/RNA Molecule: Synthetic oligonucleotide
aggagguggcugguuaugutt

SEQ ID NO: 1399 - DNA, 21 bp, Artificial Sequence
  Description of Artificial Sequence: Synthetic oligonucleotide
  Description of Combined DNA/RNA Molecule: Synthetic oligonucleotide
acauaaccagccaccuccutt

SEQ ID NO: 1400 - DNA, 21 bp, Artificial Sequence
  Description of Artificial Sequence: Synthetic oligonucleotide
  Description of Combined DNA/RNA Molecule: Synthetic oligonucleotide
ggagguggcugguuauguctt

SEQ ID NO: 1401 - DNA, 21 bp, Artificial Sequence
  Description of Artificial Sequence: Synthetic oligonucleotide
  Description of Combined DNA/RNA Molecule: Synthetic oligonucleotide
gacauaaccagccaccucctt

SEQ ID NO: 1402 - DNA, 21 bp, Artificial Sequence
  Description of Artificial Sequence: Synthetic oligonucleotide
  Description of Combined DNA/RNA Molecule: Synthetic oligonucleotide
gagguggcugguuaugucctt

SEQ ID NO: 1403 - DNA, 21 bp, Artificial Sequence
  Description of Artificial Sequence: Synthetic oligonucleotide
  Description of Combined DNA/RNA Molecule: Synthetic oligonucleotide
ggacauaaccagccaccuctt

SEQ ID NO: 1404 - DNA, 21 bp, Artificial Sequence
  Description of Artificial Sequence: Synthetic oligonucleotide
  Description of Combined DNA/RNA Molecule: Synthetic oligonucleotide
agguggcugguuauguccutt

SEQ ID NO: 1405 - DNA, 21 bp, Artificial Sequence
  Description of Artificial Sequence: Synthetic oligonucleotide
  Description of Combined DNA/RNA Molecule: Synthetic oligonucleotide
aggacauaaccagccaccutt

SEQ ID NO: 1406 - DNA, 21 bp, Artificial Sequence
  Description of Artificial Sequence: Synthetic oligonucleotide
  Description of Combined DNA/RNA Molecule: Synthetic oligonucleotide
guggcugguuauguccucatt

SEQ ID NO: 1407 - DNA, 21 bp, Artificial Sequence
  Description of Artificial Sequence: Synthetic oligonucleotide
  Description of Combined DNA/RNA Molecule: Synthetic oligonucleotide
ugaggacauaaccagccactt

SEQ ID NO: 1408 - DNA, 21 bp, Artificial Sequence
  Description of Artificial Sequence: Synthetic oligonucleotide
  Description of Combined DNA/RNA Molecule: Synthetic oligonucleotide
gcccucaacacaguggagctt

SEQ ID NO: 1409 - DNA, 21 bp, Artificial Sequence
  Description of Artificial Sequence: Synthetic oligonucleotide
  Description of Combined DNA/RNA Molecule: Synthetic oligonucleotide
gcuccacuguguugagggctt

SEQ ID NO: 1410 - DNA, 21 bp, Artificial Sequence
  Description of Artificial Sequence: Synthetic oligonucleotide
  Description of Combined DNA/RNA Molecule: Synthetic oligonucleotide
uuccuuuggaaaaccugcatt

SEQ ID NO: 1411 - DNA, 21 bp, Artificial Sequence
  Description of Artificial Sequence: Synthetic oligonucleotide
  Description of Combined DNA/RNA Molecule: Synthetic oligonucleotide
ugcagguuuuccaaaggaatt

SEQ ID NO: 1412 - DNA, 21 bp, Artificial Sequence
  Description of Artificial Sequence: Synthetic oligonucleotide
  Description of Combined DNA/RNA Molecule: Synthetic oligonucleotide
uccuuuggaaaaccugcagtt

SEQ ID NO: 1413 - DNA, 21 bp, Artificial Sequence
  Description of Artificial Sequence: Synthetic oligonucleotide
  Description of Combined DNA/RNA Molecule: Synthetic oligonucleotide
cugcagguuuuccaaaggatt

SEQ ID NO: 1414 - DNA, 21 bp, Artificial Sequence
  Description of Artificial Sequence: Synthetic oligonucleotide
  Description of Combined DNA/RNA Molecule: Synthetic oligonucleotide
gaaaaccugcagaucaucatt

SEQ ID NO: 1415 - DNA, 21 bp, Artificial Sequence
  Description of Artificial Sequence: Synthetic oligonucleotide
  Description of Combined DNA/RNA Molecule: Synthetic oligonucleotide
ugaugaucugcagguuuuctt

SEQ ID NO: 1416 - DNA, 21 bp, Artificial Sequence
  Description of Artificial Sequence: Synthetic oligonucleotide
  Description of Combined DNA/RNA Molecule: Synthetic oligonucleotide
aaaaccugcagaucaucagtt

SEQ ID NO: 1417 - DNA, 21 bp, Artificial Sequence
  Description of Artificial Sequence: Synthetic oligonucleotide
  Description of Combined DNA/RNA Molecule: Synthetic oligonucleotide
cugaugaucugcagguuuutt

SEQ ID NO: 1418 - DNA, 21 bp, Artificial Sequence
  Description of Artificial Sequence: Synthetic oligonucleotide
  Description of Combined DNA/RNA Molecule: Synthetic oligonucleotide
aaccugcagaucaucagagtt

SEQ ID NO: 1419 - DNA, 21 bp, Artificial Sequence
  Description of Artificial Sequence: Synthetic oligonucleotide
  Description of Combined DNA/RNA Molecule: Synthetic oligonucleotide
cucugaugaucugcagguutt

SEQ ID NO: 1420 - DNA, 21 bp, Artificial Sequence
  Description of Artificial Sequence: Synthetic oligonucleotide
  Description of Combined DNA/RNA Molecule: Synthetic oligonucleotide
cugcagaucaucagaggaatt

SEQ ID NO: 1421 - DNA, 21 bp, Artificial Sequence
  Description of Artificial Sequence: Synthetic oligonucleotide
  Description of Combined DNA/RNA Molecule: Synthetic oligonucleotide
uuccucugaugaucugcagtt

SEQ ID NO: 1422 - DNA, 21 bp, Artificial Sequence
  Description of Artificial Sequence: Synthetic oligonucleotide
  Description of Combined DNA/RNA Molecule: Synthetic oligonucleotide
gaaaauuccuaugccuuagtt

SEQ ID NO: 1423 - DNA, 21 bp, Artificial Sequence
  Description of Artificial Sequence: Synthetic oligonucleotide
  Description of Combined DNA/RNA Molecule: Synthetic oligonucleotide
cuaaggcauaggaauuuuctt

SEQ ID NO: 1424 - DNA, 21 bp, Artificial Sequence
  Description of Artificial Sequence: Synthetic oligonucleotide
  Description of Combined DNA/RNA Molecule: Synthetic oligonucleotide
aaaauuccuaugccuuagctt

SEQ ID NO: 1425 - DNA, 21 bp, Artificial Sequence
  Description of Artificial Sequence: Synthetic oligonucleotide
  Description of Combined DNA/RNA Molecule: Synthetic oligonucleotide
gcuaaggcauaggaauuuutt

SEQ ID NO: 1426 - DNA, 21 bp, Artificial Sequence
  Description of Artificial Sequence: Synthetic oligonucleotide
  Description of Combined DNA/RNA Molecule: Synthetic oligonucleotide
aauuccuaugccuuagcagtt

SEQ ID NO: 1427 - DNA, 21 bp, Artificial Sequence
  Description of Artificial Sequence: Synthetic oligonucleotide
  Description of Combined DNA/RNA Molecule: Synthetic oligonucleotide
cugcuaaggcauaggaauutt

SEQ ID NO: 1428 - DNA, 21 bp, Artificial Sequence
  Description of Artificial Sequence: Synthetic oligonucleotide
  Description of Combined DNA/RNA Molecule: Synthetic oligonucleotide
uccuaugccuuagcagucutt

SEQ ID NO: 1429 - DNA, 21 bp, Artificial Sequence
  Description of Artificial Sequence: Synthetic oligonucleotide
  Description of Combined DNA/RNA Molecule: Synthetic oligonucleotide
agacugcuaaggcauaggatt

SEQ ID NO: 1430 - DNA, 21 bp, Artificial Sequence
  Description of Artificial Sequence: Synthetic oligonucleotide
  Description of Combined DNA/RNA Molecule: Synthetic oligonucleotide
ccuaugccuuagcagucuutt

SEQ ID NO: 1431 - DNA, 21 bp, Artificial Sequence
  Description of Artificial Sequence: Synthetic oligonucleotide
  Description of Combined DNA/RNA Molecule: Synthetic oligonucleotide
aagacugcuaaggcauaggtt

SEQ ID NO: 1432 - DNA, 21 bp, Artificial Sequence
  Description of Artificial Sequence: Synthetic oligonucleotide
  Description of Combined DNA/RNA Molecule: Synthetic oligonucleotide
cuaugccuuagcagucuuatt

SEQ ID NO: 1433 - DNA, 21 bp, Artificial Sequence
  Description of Artificial Sequence: Synthetic oligonucleotide
  Description of Combined DNA/RNA Molecule: Synthetic oligonucleotide
uaagacugcuaaggcauagtt

SEQ ID NO: 1434 - DNA, 21 bp, Artificial Sequence
  Description of Artificial Sequence: Synthetic oligonucleotide
  Description of Combined DNA/RNA Molecule: Synthetic oligonucleotide
augccuuagcagucuuauctt

SEQ ID NO: 1435 - DNA, 21 bp, Artificial Sequence
  Description of Artificial Sequence: Synthetic oligonucleotide
  Description of Combined DNA/RNA Molecule: Synthetic oligonucleotide
gauaagacugcuaaggcautt

SEQ ID NO: 1436 - DNA, 21 bp, Artificial Sequence
  Description of Artificial Sequence: Synthetic oligonucleotide
  Description of Combined DNA/RNA Molecule: Synthetic oligonucleotide
ugccuuagcagucuuaucutt

SEQ ID NO: 1437 - DNA, 21 bp, Artificial Sequence
  Description of Artificial Sequence: Synthetic oligonucleotide
  Description of Combined DNA/RNA Molecule: Synthetic oligonucleotide
agauaagacugcuaaggcatt

SEQ ID NO: 1438 - DNA, 21 bp, Artificial Sequence
  Description of Artificial Sequence: Synthetic oligonucleotide
  Description of Combined DNA/RNA Molecule: Synthetic oligonucleotide
gccuuagcagucuuaucuatt

SEQ ID NO: 1439 - DNA, 21 bp, Artificial Sequence
  Description of Artificial Sequence: Synthetic oligonucleotide
  Description of Combined DNA/RNA Molecule: Synthetic oligonucleotide
uagauaagacugcuaaggctt

SEQ ID NO: 1440 - DNA, 21 bp, Artificial Sequence
  Description of Artificial Sequence: Synthetic oligonucleotide
  Description of Combined DNA/RNA Molecule: Synthetic oligonucleotide
ccuuagcagucuuaucuaatt

SEQ ID NO: 1441 - DNA, 21 bp, Artificial Sequence
  Description of Artificial Sequence: Synthetic oligonucleotide
  Description of Combined DNA/RNA Molecule: Synthetic oligonucleotide
uuagauaagacugcuaaggtt

SEQ ID NO: 1442 - DNA, 21 bp, Artificial Sequence
  Description of Artificial Sequence: Synthetic oligonucleotide
  Description of Combined DNA/RNA Molecule: Synthetic oligonucleotide
cuuagcagucuuaucuaactt

SEQ ID NO: 1443 - DNA, 21 bp, Artificial Sequence
  Description of Artificial Sequence: Synthetic oligonucleotide
  Description of Combined DNA/RNA Molecule: Synthetic oligonucleotide
guuagauaagacugcuaagtt

SEQ ID NO: 1444 - DNA, 21 bp, Artificial Sequence
  Description of Artificial Sequence: Synthetic oligonucleotide
  Description of Combined DNA/RNA Molecule: Synthetic oligonucleotide
uuagcagucuuaucuaacutt

SEQ ID NO: 1445 - DNA, 21 bp, Artificial Sequence
  Description of Artificial Sequence: Synthetic oligonucleotide
  Description of Combined DNA/RNA Molecule: Synthetic oligonucleotide
aguuagauaagacugcuaatt

SEQ ID NO: 1446 - DNA, 21 bp, Artificial Sequence
  Description of Artificial Sequence: Synthetic oligonucleotide
  Description of Combined DNA/RNA Molecule: Synthetic oligonucleotide
uagcagucuuaucuaacuatt

SEQ ID NO: 1447 - DNA, 21 bp, Artificial Sequence
  Description of Artificial Sequence: Synthetic oligonucleotide
  Description of Combined DNA/RNA Molecule: Synthetic oligonucleotide
uaguuagauaagacugcuatt

SEQ ID NO: 1448 - DNA, 21 bp, Artificial Sequence
  Description of Artificial Sequence: Synthetic oligonucleotide
  Description of Combined DNA/RNA Molecule: Synthetic oligonucleotide
agcagucuuaucuaacuautt

SEQ ID NO: 1449 - DNA, 21 bp, Artificial Sequence
  Description of Artificial Sequence: Synthetic oligonucleotide
  Description of Combined DNA/RNA Molecule: Synthetic oligonucleotide
auaguuagauaagacugcutt

SEQ ID NO: 1450 - DNA, 21 bp, Artificial Sequence
  Description of Artificial Sequence: Synthetic oligonucleotide
  Description of Combined DNA/RNA Molecule: Synthetic oligonucleotide
gcagucuuaucuaacuaugtt

SEQ ID NO: 1451 - DNA, 21 bp, Artificial Sequence
  Description of Artificial Sequence: Synthetic oligonucleotide
  Description of Combined DNA/RNA Molecule: Synthetic oligonucleotide
cauaguuagauaagacugctt

SEQ ID NO: 1452 - DNA, 21 bp, Artificial Sequence
  Description of Artificial Sequence: Synthetic oligonucleotide
  Description of Combined DNA/RNA Molecule: Synthetic oligonucleotide
cagucuuaucuaacuaugatt

SEQ ID NO: 1453 - DNA, 21 bp, Artificial Sequence
  Description of Artificial Sequence: Synthetic oligonucleotide
  Description of Combined DNA/RNA Molecule: Synthetic oligonucleotide
ucauaguuagauaagacugtt

SEQ ID NO: 1454 - DNA, 21 bp, Artificial Sequence
  Description of Artificial Sequence: Synthetic oligonucleotide
  Description of Combined DNA/RNA Molecule: Synthetic oligonucleotide
ucuuaucuaacuaugaugctt

SEQ ID NO: 1455 - DNA, 21 bp, Artificial Sequence
  Description of Artificial Sequence: Synthetic oligonucleotide
  Description of Combined DNA/RNA Molecule: Synthetic oligonucleotide
gcaucauaguuagauaagatt

SEQ ID NO: 1456 - DNA, 21 bp, Artificial Sequence
  Description of Artificial Sequence: Synthetic oligonucleotide
  Description of Combined DNA/RNA Molecule: Synthetic oligonucleotide
cuuaucuaacuaugaugcatt

SEQ ID NO: 1457 - DNA, 21 bp, Artificial Sequence
  Description of Artificial Sequence: Synthetic oligonucleotide
  Description of Combined DNA/RNA Molecule: Synthetic oligonucleotide
ugcaucauaguuagauaagtt

SEQ ID NO: 1458 - DNA, 21 bp, Artificial Sequence
  Description of Artificial Sequence: Synthetic oligonucleotide
  Description of Combined DNA/RNA Molecule: Synthetic oligonucleotide
uuaucuaacuaugaugcaatt

SEQ ID NO: 1459 - DNA, 21 bp, Artificial Sequence
  Description of Artificial Sequence: Synthetic oligonucleotide
  Description of Combined DNA/RNA Molecule: Synthetic oligonucleotide
uugcaucauaguuagauaatt

SEQ ID NO: 1460 - DNA, 21 bp, Artificial Sequence
  Description of Artificial Sequence: Synthetic oligonucleotide
  Description of Combined DNA/RNA Molecule: Synthetic oligonucleotide
uaucuaacuaugaugcaaatt

SEQ ID NO: 1461 - DNA, 21 bp, Artificial Sequence
  Description of Artificial Sequence: Synthetic oligonucleotide
  Description of Combined DNA/RNA Molecule: Synthetic oligonucleotide
uuugcaucauaguuagauatt

SEQ ID NO: 1462 - DNA, 21 bp, Artificial Sequence
  Description of Artificial Sequence: Synthetic oligonucleotide
  Description of Combined DNA/RNA Molecule: Synthetic oligonucleotide
aucuaacuaugaugcaaautt

SEQ ID NO: 1463 - DNA, 21 bp, Artificial Sequence
  Description of Artificial Sequence: Synthetic oligonucleotide
  Description of Combined DNA/RNA Molecule: Synthetic oligonucleotide
auuugcaucauaguuagautt

SEQ ID NO: 1464 - DNA, 21 bp, Artificial Sequence
  Description of Artificial Sequence: Synthetic oligonucleotide
  Description of Combined DNA/RNA Molecule: Synthetic oligonucleotide
ucuaacuaugaugcaaauatt

SEQ ID NO: 1465 - DNA, 21 bp, Artificial Sequence
  Description of Artificial Sequence: Synthetic oligonucleotide
  Description of Combined DNA/RNA Molecule: Synthetic oligonucleotide
uauuugcaucauaguuagatt

SEQ ID NO: 1466 - DNA, 21 bp, Artificial Sequence
  Description of Artificial Sequence: Synthetic oligonucleotide
  Description of Combined DNA/RNA Molecule: Synthetic oligonucleotide
cuaacuaugaugcaaauaatt

SEQ ID NO: 1467 - DNA, 21 bp, Artificial Sequence
  Description of Artificial Sequence: Synthetic oligonucleotide
  Description of Combined DNA/RNA Molecule: Synthetic oligonucleotide
uuauuugcaucauaguuagtt

SEQ ID NO: 1468 - DNA, 21 bp, Artificial Sequence
  Description of Artificial Sequence: Synthetic oligonucleotide
  Description of Combined DNA/RNA Molecule: Synthetic oligonucleotide
aacuaugaugcaaauaaaatt

SEQ ID NO: 1469 - DNA, 21 bp, Artificial Sequence
  Description of Artificial Sequence: Synthetic oligonucleotide
  Description of Combined DNA/RNA Molecule: Synthetic oligonucleotide
uuuuauuugcaucauaguutt

SEQ ID NO: 1470 - DNA, 21 bp, Artificial Sequence
  Description of Artificial Sequence: Synthetic oligonucleotide
  Description of Combined DNA/RNA Molecule: Synthetic oligonucleotide
gaugcaaauaaaaccggactt

SEQ ID NO: 1471 - DNA, 21 bp, Artificial Sequence
  Description of Artificial Sequence: Synthetic oligonucleotide
  Description of Combined DNA/RNA Molecule: Synthetic oligonucleotide
guccgguuuuauuugcauctt

SEQ ID NO: 1472 - DNA, 21 bp, Artificial Sequence
  Description of Artificial Sequence: Synthetic oligonucleotide
  Description of Combined DNA/RNA Molecule: Synthetic oligonucleotide
augcaaauaaaaccggacutt

SEQ ID NO: 1473 - DNA, 21 bp, Artificial Sequence
  Description of Artificial Sequence: Synthetic oligonucleotide
  Description of Combined DNA/RNA Molecule: Synthetic oligonucleotide
aguccgguuuuauuugcautt

SEQ ID NO: 1474 - DNA, 21 bp, Artificial Sequence
  Description of Artificial Sequence: Synthetic oligonucleotide
  Description of Combined DNA/RNA Molecule: Synthetic oligonucleotide
ugcaaauaaaaccggacugtt

SEQ ID NO: 1475 - DNA, 21 bp, Artificial Sequence
  Description of Artificial Sequence: Synthetic oligonucleotide
  Description of Combined DNA/RNA Molecule: Synthetic oligonucleotide
caguccgguuuuauuugcatt

SEQ ID NO: 1476 - DNA, 21 bp, Artificial Sequence
  Description of Artificial Sequence: Synthetic oligonucleotide
  Description of Combined DNA/RNA Molecule: Synthetic oligonucleotide
caaauaaaaccggacugaatt

SEQ ID NO: 1477 - DNA, 21 bp, Artificial Sequence
  Description of Artificial Sequence: Synthetic oligonucleotide
  Description of Combined DNA/RNA Molecule: Synthetic oligonucleotide
uucaguccgguuuuauuugtt

SEQ ID NO: 1478 - DNA, 21 bp, Artificial Sequence
  Description of Artificial Sequence: Synthetic oligonucleotide
  Description of Combined DNA/RNA Molecule: Synthetic oligonucleotide
aaauaaaaccggacugaagtt

SEQ ID NO: 1479 - DNA, 21 bp, Artificial Sequence
  Description of Artificial Sequence: Synthetic oligonucleotide
  Description of Combined DNA/RNA Molecule: Synthetic oligonucleotide
cuucaguccgguuuuauuutt

SEQ ID NO: 1480 - DNA, 21 bp, Artificial Sequence
  Description of Artificial Sequence: Synthetic oligonucleotide
  Description of Combined DNA/RNA Molecule: Synthetic oligonucleotide
aauaaaaccggacugaaggtt

SEQ ID NO: 1481 - DNA, 21 bp, Artificial Sequence
  Description of Artificial Sequence: Synthetic oligonucleotide
  Description of Combined DNA/RNA Molecule: Synthetic oligonucleotide
ccuucaguccgguuuuauutt

SEQ ID NO: 1482 - DNA, 21 bp, Artificial Sequence
  Description of Artificial Sequence: Synthetic oligonucleotide
  Description of Combined DNA/RNA Molecule: Synthetic oligonucleotide
uaaaaccggacugaaggagtt

SEQ ID NO: 1483 - DNA, 21 bp, Artificial Sequence
  Description of Artificial Sequence: Synthetic oligonucleotide
  Description of Combined DNA/RNA Molecule: Synthetic oligonucleotide
cuccuucaguccgguuuuatt

SEQ ID NO: 1484 - DNA, 21 bp, Artificial Sequence
  Description of Artificial Sequence: Synthetic oligonucleotide
  Description of Combined DNA/RNA Molecule: Synthetic oligonucleotide
aaaaccggacugaaggagctt

SEQ ID NO: 1485 - DNA, 21 bp, Artificial Sequence
  Description of Artificial Sequence: Synthetic oligonucleotide
  Description of Combined DNA/RNA Molecule: Synthetic oligonucleotide
gcuccuucaguccgguuuutt

SEQ ID NO: 1486 - DNA, 21 bp, Artificial Sequence
  Description of Artificial Sequence: Synthetic oligonucleotide
  Description of Combined DNA/RNA Molecule: Synthetic oligonucleotide
aaaccggacugaaggagcutt

SEQ ID NO: 1487 - DNA, 21 bp, Artificial Sequence
  Description of Artificial Sequence: Synthetic oligonucleotide
  Description of Combined DNA/RNA Molecule: Synthetic oligonucleotide
agcuccuucaguccgguuutt

SEQ ID NO: 1488 - DNA, 21 bp, Artificial Sequence
  Description of Artificial Sequence: Synthetic oligonucleotide
  Description of Combined DNA/RNA Molecule: Synthetic oligonucleotide
aaccggacugaaggagcugtt

SEQ ID NO: 1489 - DNA, 21 bp, Artificial Sequence
  Description of Artificial Sequence: Synthetic oligonucleotide
  Description of Combined DNA/RNA Molecule: Synthetic oligonucleotide
cagcuccuucaguccgguutt

SEQ ID NO: 1490 - DNA, 21 bp, Artificial Sequence
  Description of Artificial Sequence: Synthetic oligonucleotide
  Description of Combined DNA/RNA Molecule: Synthetic oligonucleotide
aggagcugcccaugagaaatt

SEQ ID NO: 1491 - DNA, 21 bp, Artificial Sequence
  Description of Artificial Sequence: Synthetic oligonucleotide
  Description of Combined DNA/RNA Molecule: Synthetic oligonucleotide
uuucucaugggcagcuccutt

SEQ ID NO: 1492 - DNA, 21 bp, Artificial Sequence
  Description of Artificial Sequence: Synthetic oligonucleotide
  Description of Combined DNA/RNA Molecule: Synthetic oligonucleotide
uacaggaaauccugcauggtt

SEQ ID NO: 1493 - DNA, 21 bp, Artificial Sequence
  Description of Artificial Sequence: Synthetic oligonucleotide
  Description of Combined DNA/RNA Molecule: Synthetic oligonucleotide
ccaugcaggauuuccuguatt

SEQ ID NO: 1494 - DNA, 21 bp, Artificial Sequence
  Description of Artificial Sequence: Synthetic oligonucleotide
  Description of Combined DNA/RNA Molecule: Synthetic oligonucleotide
aggaaauccugcauggcgctt

SEQ ID NO: 1495 - DNA, 21 bp, Artificial Sequence
  Description of Artificial Sequence: Synthetic oligonucleotide
  Description of Combined DNA/RNA Molecule: Synthetic oligonucleotide
gcgccaugcaggauuuccutt

SEQ ID NO: 1496 - DNA, 21 bp, Artificial Sequence
  Description of Artificial Sequence: Synthetic oligonucleotide
  Description of Combined DNA/RNA Molecule: Synthetic oligonucleotide
ggaaauccugcauggcgcctt

SEQ ID NO: 1497 - DNA, 21 bp, Artificial Sequence
  Description of Artificial Sequence: Synthetic oligonucleotide
  Description of Combined DNA/RNA Molecule: Synthetic oligonucleotide
ggcgccaugcaggauuucctt

SEQ ID NO: 1498 - DNA, 21 bp, Artificial Sequence
  Description of Artificial Sequence: Synthetic oligonucleotide
  Description of Combined DNA/RNA Molecule: Synthetic oligonucleotide
gaaauccugcauggcgccgtt

SEQ ID NO: 1499 - DNA, 21 bp, Artificial Sequence
  Description of Artificial Sequence: Synthetic oligonucleotide
  Description of Combined DNA/RNA Molecule: Synthetic oligonucleotide
cggcgccaugcaggauuuctt

SEQ ID NO: 1500 - DNA, 21 bp, Artificial Sequence
  Description of Artificial Sequence: Synthetic oligonucleotide
  Description of Combined DNA/RNA Molecule: Synthetic oligonucleotide
aaauccugcauggcgccgutt

SEQ ID NO: 1501 - DNA, 21 bp, Artificial Sequence
  Description of Artificial Sequence: Synthetic oligonucleotide
  Description of Combined DNA/RNA Molecule: Synthetic oligonucleotide
acggcgccaugcaggauuutt

SEQ ID NO: 1502 - DNA, 21 bp, Artificial Sequence
  Description of Artificial Sequence: Synthetic oligonucleotide
  Description of Combined DNA/RNA Molecule: Synthetic oligonucleotide
aauccugcauggcgccgugtt

SEQ ID NO: 1503 - DNA, 21 bp, Artificial Sequence
  Description of Artificial Sequence: Synthetic oligonucleotide
  Description of Combined DNA/RNA Molecule: Synthetic oligonucleotide
cacggcgccaugcaggauutt

SEQ ID NO: 1504 - DNA, 21 bp, Artificial Sequence
  Description of Artificial Sequence: Synthetic oligonucleotide
  Description of Combined DNA/RNA Molecule: Synthetic oligonucleotide
uccugcauggcgccgugcgtt

SEQ ID NO: 1505 - DNA, 21 bp, Artificial Sequence
  Description of Artificial Sequence: Synthetic oligonucleotide
  Description of Combined DNA/RNA Molecule: Synthetic oligonucleotide
cgcacggcgccaugcaggatt

SEQ ID NO: 1506 - DNA, 21 bp, Artificial Sequence
  Description of Artificial Sequence: Synthetic oligonucleotide
  Description of Combined DNA/RNA Molecule: Synthetic oligonucleotide
cugcauggcgccgugcggutt

SEQ ID NO: 1507 - DNA, 21 bp, Artificial Sequence
  Description of Artificial Sequence: Synthetic oligonucleotide
  Description of Combined DNA/RNA Molecule: Synthetic oligonucleotide
accgcacggcgccaugcagtt

SEQ ID NO: 1508 - DNA, 21 bp, Artificial Sequence
  Description of Artificial Sequence: Synthetic oligonucleotide
  Description of Combined DNA/RNA Molecule: Synthetic oligonucleotide
ugcauggcgccgugcgguutt

SEQ ID NO: 1509 - DNA, 21 bp, Artificial Sequence
  Description of Artificial Sequence: Synthetic oligonucleotide
  Description of Combined DNA/RNA Molecule: Synthetic oligonucleotide
aaccgcacggcgccaugcatt

SEQ ID NO: 1510 - DNA, 21 bp, Artificial Sequence
  Description of Artificial Sequence: Synthetic oligonucleotide
  Description of Combined DNA/RNA Molecule: Synthetic oligonucleotide
gcauggcgccgugcgguuctt

SEQ ID NO: 1511 - DNA, 21 bp, Artificial Sequence
  Description of Artificial Sequence: Synthetic oligonucleotide
  Description of Combined DNA/RNA Molecule: Synthetic oligonucleotide
gaaccgcacggcgccaugctt

SEQ ID NO: 1512 - DNA, 21 bp, Artificial Sequence
  Description of Artificial Sequence: Synthetic oligonucleotide
  Description of Combined DNA/RNA Molecule: Synthetic oligonucleotide
auggcgccgugcgguucagtt

SEQ ID NO: 1513 - DNA, 21 bp, Artificial Sequence
  Description of Artificial Sequence: Synthetic oligonucleotide
  Description of Combined DNA/RNA Molecule: Synthetic oligonucleotide
cugaaccgcacggcgccautt

SEQ ID NO: 1514 - DNA, 21 bp, Artificial Sequence
  Description of Artificial Sequence: Synthetic oligonucleotide
  Description of Combined DNA/RNA Molecule: Synthetic oligonucleotide
uggcgccgugcgguucagctt

SEQ ID NO: 1515 - DNA, 21 bp, Artificial Sequence
  Description of Artificial Sequence: Synthetic oligonucleotide
  Description of Combined DNA/RNA Molecule: Synthetic oligonucleotide
gcugaaccgcacggcgccatt

SEQ ID NO: 1516 - DNA, 21 bp, Artificial Sequence
  Description of Artificial Sequence: Synthetic oligonucleotide
  Description of Combined DNA/RNA Molecule: Synthetic oligonucleotide
ggcgccgugcgguucagcatt

SEQ ID NO: 1517 - DNA, 21 bp, Artificial Sequence
  Description of Artificial Sequence: Synthetic oligonucleotide
  Description of Combined DNA/RNA Molecule: Synthetic oligonucleotide
ugcugaaccgcacggcgcctt

SEQ ID NO: 1518 - DNA, 21 bp, Artificial Sequence
  Description of Artificial Sequence: Synthetic oligonucleotide
  Description of Combined DNA/RNA Molecule: Synthetic oligonucleotide
gcgccgugcgguucagcaatt

SEQ ID NO: 1519 - DNA, 21 bp, Artificial Sequence
  Description of Artificial Sequence: Synthetic oligonucleotide
  Description of Combined DNA/RNA Molecule: Synthetic oligonucleotide
uugcugaaccgcacggcgctt

SEQ ID NO: 1520 - DNA, 21 bp, Artificial Sequence
  Description of Artificial Sequence: Synthetic oligonucleotide
  Description of Combined DNA/RNA Molecule: Synthetic oligonucleotide
cgccgugcgguucagcaactt

SEQ ID NO: 1521 - DNA, 21 bp, Artificial Sequence
  Description of Artificial Sequence: Synthetic oligonucleotide
  Description of Combined DNA/RNA Molecule: Synthetic oligonucleotide
guugcugaaccgcacggcgtt

SEQ ID NO: 1522 - DNA, 21 bp, Artificial Sequence
  Description of Artificial Sequence: Synthetic oligonucleotide
  Description of Combined DNA/RNA Molecule: Synthetic oligonucleotide
gccgugcgguucagcaacatt

SEQ ID NO: 1523 - DNA, 21 bp, Artificial Sequence
  Description of Artificial Sequence: Synthetic oligonucleotide
  Description of Combined DNA/RNA Molecule: Synthetic oligonucleotide
uguugcugaaccgcacggctt

SEQ ID NO: 1524 - DNA, 21 bp, Artificial Sequence
  Description of Artificial Sequence: Synthetic oligonucleotide
  Description of Combined DNA/RNA Molecule: Synthetic oligonucleotide
ccgugcgguucagcaacaatt

SEQ ID NO: 1525 - DNA, 21 bp, Artificial Sequence
  Description of Artificial Sequence: Synthetic oligonucleotide
  Description of Combined DNA/RNA Molecule: Synthetic oligonucleotide
uuguugcugaaccgcacggtt

SEQ ID NO: 1526 - DNA, 21 bp, Artificial Sequence
  Description of Artificial Sequence: Synthetic oligonucleotide
  Description of Combined DNA/RNA Molecule: Synthetic oligonucleotide
gugcgguucagcaacaacctt

SEQ ID NO: 1527 - DNA, 21 bp, Artificial Sequence
  Description of Artificial Sequence: Synthetic oligonucleotide
  Description of Combined DNA/RNA Molecule: Synthetic oligonucleotide
gguuguugcugaaccgcactt

SEQ ID NO: 1528 - DNA, 21 bp, Artificial Sequence
  Description of Artificial Sequence: Synthetic oligonucleotide
  Description of Combined DNA/RNA Molecule: Synthetic oligonucleotide
gcgguucagcaacaacccutt

SEQ ID NO: 1529 - DNA, 21 bp, Artificial Sequence
  Description of Artificial Sequence: Synthetic oligonucleotide
  Description of Combined DNA/RNA Molecule: Synthetic oligonucleotide
aggguuguugcugaaccgctt

SEQ ID NO: 1530 - DNA, 21 bp, Artificial Sequence
  Description of Artificial Sequence: Synthetic oligonucleotide
  Description of Combined DNA/RNA Molecule: Synthetic oligonucleotide
gguucagcaacaacccugctt

SEQ ID NO: 1531 - DNA, 21 bp, Artificial Sequence
  Description of Artificial Sequence: Synthetic oligonucleotide
  Description of Combined DNA/RNA Molecule: Synthetic oligonucleotide
gcaggguuguugcugaacctt

SEQ ID NO: 1532 - DNA, 21 bp, Artificial Sequence
  Description of Artificial Sequence: Synthetic oligonucleotide
  Description of Combined DNA/RNA Molecule: Synthetic oligonucleotide
gcaacaacccugcccugugtt

SEQ ID NO: 1533 - DNA, 21 bp, Artificial Sequence
  Description of Artificial Sequence: Synthetic oligonucleotide
  Description of Combined DNA/RNA Molecule: Synthetic oligonucleotide
cacagggcaggguuguugctt

SEQ ID NO: 1534 - DNA, 21 bp, Artificial Sequence
  Description of Artificial Sequence: Synthetic oligonucleotide
  Description of Combined DNA/RNA Molecule: Synthetic oligonucleotide
aacaacccugcccugugcatt

SEQ ID NO: 1535 - DNA, 21 bp, Artificial Sequence
  Description of Artificial Sequence: Synthetic oligonucleotide
  Description of Combined DNA/RNA Molecule: Synthetic oligonucleotide
ugcacagggcaggguuguutt

SEQ ID NO: 1536 - DNA, 21 bp, Artificial Sequence
  Description of Artificial Sequence: Synthetic oligonucleotide
  Description of Combined DNA/RNA Molecule: Synthetic oligonucleotide
acguggagagcauccagugtt

SEQ ID NO: 1537 - DNA, 21 bp, Artificial Sequence
  Description of Artificial Sequence: Synthetic oligonucleotide
  Description of Combined DNA/RNA Molecule: Synthetic oligonucleotide
cacuggaugcucuccacgutt

SEQ ID NO: 1538 - DNA, 21 bp, Artificial Sequence
  Description of Artificial Sequence: Synthetic oligonucleotide
  Description of Combined DNA/RNA Molecule: Synthetic oligonucleotide
cguggagagcauccaguggtt

SEQ ID NO: 1539 - DNA, 21 bp, Artificial Sequence
  Description of Artificial Sequence: Synthetic oligonucleotide
  Description of Combined DNA/RNA Molecule: Synthetic oligonucleotide
ccacuggaugcucuccacgtt

SEQ ID NO: 1540 - DNA, 21 bp, Artificial Sequence
  Description of Artificial Sequence: Synthetic oligonucleotide
  Description of Combined DNA/RNA Molecule: Synthetic oligonucleotide
guggagagcauccaguggctt

SEQ ID NO: 1541 - DNA, 21 bp, Artificial Sequence
  Description of Artificial Sequence: Synthetic oligonucleotide
  Description of Combined DNA/RNA Molecule: Synthetic oligonucleotide
gccacuggaugcucuccactt

SEQ ID NO: 1542 - DNA, 21 bp, Artificial Sequence
  Description of Artificial Sequence: Synthetic oligonucleotide
  Description of Combined DNA/RNA Molecule: Synthetic oligonucleotide
gagagcauccaguggcgggtt

SEQ ID NO: 1543 - DNA, 21 bp, Artificial Sequence
  Description of Artificial Sequence: Synthetic oligonucleotide
  Description of Combined DNA/RNA Molecule: Synthetic oligonucleotide
cccgccacuggaugcucuctt

SEQ ID NO: 1544 - DNA, 21 bp, Artificial Sequence
  Description of Artificial Sequence: Synthetic oligonucleotide
  Description of Combined DNA/RNA Molecule: Synthetic oligonucleotide
agagcauccaguggcgggatt

SEQ ID NO: 1545 - DNA, 21 bp, Artificial Sequence
  Description of Artificial Sequence: Synthetic oligonucleotide
  Description of Combined DNA/RNA Molecule: Synthetic oligonucleotide
ucccgccacuggaugcucutt

SEQ ID NO: 1546 - DNA, 21 bp, Artificial Sequence
  Description of Artificial Sequence: Synthetic oligonucleotide
  Description of Combined DNA/RNA Molecule: Synthetic oligonucleotide
gagcauccaguggcgggactt

SEQ ID NO: 1547 - DNA, 21 bp, Artificial Sequence
  Description of Artificial Sequence: Synthetic oligonucleotide
  Description of Combined DNA/RNA Molecule: Synthetic oligonucleotide
gucccgccacuggaugcuctt

SEQ ID NO: 1548 - DNA, 21 bp, Artificial Sequence
  Description of Artificial Sequence: Synthetic oligonucleotide
  Description of Combined DNA/RNA Molecule: Synthetic oligonucleotide
caguggcgggacauagucatt

SEQ ID NO: 1549 - DNA, 21 bp, Artificial Sequence
  Description of Artificial Sequence: Synthetic oligonucleotide
  Description of Combined DNA/RNA Molecule: Synthetic oligonucleotide
ugacuaugucccgccacugtt

SEQ ID NO: 1550 - DNA, 21 bp, Artificial Sequence
  Description of Artificial Sequence: Synthetic oligonucleotide
  Description of Combined DNA/RNA Molecule: Synthetic oligonucleotide
aguggcgggacauagucagtt

SEQ ID NO: 1551 - DNA, 21 bp, Artificial Sequence
  Description of Artificial Sequence: Synthetic oligonucleotide
  Description of Combined DNA/RNA Molecule: Synthetic oligonucleotide
cugacuaugucccgccacutt

SEQ ID NO: 1552 - DNA, 21 bp, Artificial Sequence
  Description of Artificial Sequence: Synthetic oligonucleotide
  Description of Combined DNA/RNA Molecule: Synthetic oligonucleotide
uggcgggacauagucagcatt

SEQ ID NO: 1553 - DNA, 21 bp, Artificial Sequence
  Description of Artificial Sequence: Synthetic oligonucleotide
  Description of Combined DNA/RNA Molecule: Synthetic oligonucleotide
ugcugacuaugucccgccatt

SEQ ID NO: 1554 - DNA, 21 bp, Artificial Sequence
  Description of Artificial Sequence: Synthetic oligonucleotide
  Description of Combined DNA/RNA Molecule: Synthetic oligonucleotide
ggcgggacauagucagcagtt

SEQ ID NO: 1555 - DNA, 21 bp, Artificial Sequence
  Description of Artificial Sequence: Synthetic oligonucleotide
  Description of Combined DNA/RNA Molecule: Synthetic oligonucleotide
cugcugacuaugucccgcctt

SEQ ID NO: 1556 - DNA, 21 bp, Artificial Sequence
  Description of Artificial Sequence: Synthetic oligonucleotide
  Description of Combined DNA/RNA Molecule: Synthetic oligonucleotide
cucagcaacaugucgauggtt

SEQ ID NO: 1557 - DNA, 21 bp, Artificial Sequence
  Description of Artificial Sequence: Synthetic oligonucleotide
  Description of Combined DNA/RNA Molecule: Synthetic oligonucleotide
ccaucgacauguugcugagtt

SEQ ID NO: 1558 - DNA, 21 bp, Artificial Sequence
  Description of Artificial Sequence: Synthetic oligonucleotide
  Description of Combined DNA/RNA Molecule: Synthetic oligonucleotide
cagcaacaugucgauggactt

SEQ ID NO: 1559 - DNA, 21 bp, Artificial Sequence
  Description of Artificial Sequence: Synthetic oligonucleotide
  Description of Combined DNA/RNA Molecule: Synthetic oligonucleotide
guccaucgacauguugcugtt

SEQ ID NO: 1560 - DNA, 21 bp, Artificial Sequence
  Description of Artificial Sequence: Synthetic oligonucleotide
  Description of Combined DNA/RNA Molecule: Synthetic oligonucleotide
agcaacaugucgauggacutt

SEQ ID NO: 1561 - DNA, 21 bp, Artificial Sequence
  Description of Artificial Sequence: Synthetic oligonucleotide
  Description of Combined DNA/RNA Molecule: Synthetic oligonucleotide
aguccaucgacauguugcutt

SEQ ID NO: 1562 - DNA, 21 bp, Artificial Sequence
  Description of Artificial Sequence: Synthetic oligonucleotide
  Description of Combined DNA/RNA Molecule: Synthetic oligonucleotide
gcaacaugucgauggacuutt

SEQ ID NO: 1563 - DNA, 21 bp, Artificial Sequence
  Description of Artificial Sequence: Synthetic oligonucleotide
  Description of Combined DNA/RNA Molecule: Synthetic oligonucleotide
aaguccaucgacauguugctt

SEQ ID NO: 1564 - DNA, 21 bp, Artificial Sequence
  Description of Artificial Sequence: Synthetic oligonucleotide
  Description of Combined DNA/RNA Molecule: Synthetic oligonucleotide
aacaugucgauggacuucctt

SEQ ID NO: 1565 - DNA, 21 bp, Artificial Sequence
  Description of Artificial Sequence: Synthetic oligonucleotide
  Description of Combined DNA/RNA Molecule: Synthetic oligonucleotide
ggaaguccaucgacauguutt

SEQ ID NO: 1566 - DNA, 21 bp, Artificial Sequence
  Description of Artificial Sequence: Synthetic oligonucleotide
  Description of Combined DNA/RNA Molecule: Synthetic oligonucleotide
acaugucgauggacuuccatt

SEQ ID NO: 1567 - DNA, 21 bp, Artificial Sequence
  Description of Artificial Sequence: Synthetic oligonucleotide
  Description of Combined DNA/RNA Molecule: Synthetic oligonucleotide
uggaaguccaucgacaugutt

SEQ ID NO: 1568 - DNA, 21 bp, Artificial Sequence
  Description of Artificial Sequence: Synthetic oligonucleotide
  Description of Combined DNA/RNA Molecule: Synthetic oligonucleotide
caugucgauggacuuccagtt

SEQ ID NO: 1569 - DNA, 21 bp, Artificial Sequence
  Description of Artificial Sequence: Synthetic oligonucleotide
  Description of Combined DNA/RNA Molecule: Synthetic oligonucleotide
cuggaaguccaucgacaugtt

SEQ ID NO: 1570 - DNA, 21 bp, Artificial Sequence
  Description of Artificial Sequence: Synthetic oligonucleotide
  Description of Combined DNA/RNA Molecule: Synthetic oligonucleotide
augucgauggacuuccagatt

SEQ ID NO: 1571 - DNA, 21 bp, Artificial Sequence
  Description of Artificial Sequence: Synthetic oligonucleotide
  Description of Combined DNA/RNA Molecule: Synthetic oligonucleotide
ucuggaaguccaucgacautt

SEQ ID NO: 1572 - DNA, 21 bp, Artificial Sequence
  Description of Artificial Sequence: Synthetic oligonucleotide
  Description of Combined DNA/RNA Molecule: Synthetic oligonucleotide
ucgauggacuuccagaacctt

SEQ ID NO: 1573 - DNA, 21 bp, Artificial Sequence
  Description of Artificial Sequence: Synthetic oligonucleotide
  Description of Combined DNA/RNA Molecule: Synthetic oligonucleotide
gguucuggaaguccaucgatt

SEQ ID NO: 1574 - DNA, 21 bp, Artificial Sequence
  Description of Artificial Sequence: Synthetic oligonucleotide
  Description of Combined DNA/RNA Molecule: Synthetic oligonucleotide
gaaccaccugggcagcugctt

SEQ ID NO: 1575 - DNA, 21 bp, Artificial Sequence
  Description of Artificial Sequence: Synthetic oligonucleotide
  Description of Combined DNA/RNA Molecule: Synthetic oligonucleotide
gcagcugcccaggugguuctt

SEQ ID NO: 1576 - DNA, 21 bp, Artificial Sequence
  Description of Artificial Sequence: Synthetic oligonucleotide
  Description of Combined DNA/RNA Molecule: Synthetic oligonucleotide
gggcagcugccaaaagugutt

SEQ ID NO: 1577 - DNA, 21 bp, Artificial Sequence
  Description of Artificial Sequence: Synthetic oligonucleotide
  Description of Combined DNA/RNA Molecule: Synthetic oligonucleotide
acacuuuuggcagcugccctt

SEQ ID NO: 1578 - DNA, 21 bp, Artificial Sequence
  Description of Artificial Sequence: Synthetic oligonucleotide
  Description of Combined DNA/RNA Molecule: Synthetic oligonucleotide
gcagcugccaaaagugugatt

SEQ ID NO: 1579 - DNA, 21 bp, Artificial Sequence
  Description of Artificial Sequence: Synthetic oligonucleotide
  Description of Combined DNA/RNA Molecule: Synthetic oligonucleotide
ucacacuuuuggcagcugctt

SEQ ID NO: 1580 - DNA, 21 bp, Artificial Sequence
  Description of Artificial Sequence: Synthetic oligonucleotide
  Description of Combined DNA/RNA Molecule: Synthetic oligonucleotide
ugccaaaagugugauccaatt

SEQ ID NO: 1581 - DNA, 21 bp, Artificial Sequence
  Description of Artificial Sequence: Synthetic oligonucleotide
  Description of Combined DNA/RNA Molecule: Synthetic oligonucleotide
uuggaucacacuuuuggcatt

SEQ ID NO: 1582 - DNA, 21 bp, Artificial Sequence
  Description of Artificial Sequence: Synthetic oligonucleotide
  Description of Combined DNA/RNA Molecule: Synthetic oligonucleotide
gccaaaagugugauccaagtt

SEQ ID NO: 1583 - DNA, 21 bp, Artificial Sequence
  Description of Artificial Sequence: Synthetic oligonucleotide
  Description of Combined DNA/RNA Molecule: Synthetic oligonucleotide
cuuggaucacacuuuuggctt

SEQ ID NO: 1584 - DNA, 21 bp, Artificial Sequence
  Description of Artificial Sequence: Synthetic oligonucleotide
  Description of Combined DNA/RNA Molecule: Synthetic oligonucleotide
ccaaaagugugauccaagctt

SEQ ID NO: 1585 - DNA, 21 bp, Artificial Sequence
  Description of Artificial Sequence: Synthetic oligonucleotide
  Description of Combined DNA/RNA Molecule: Synthetic oligonucleotide
gcuuggaucacacuuuuggtt

SEQ ID NO: 1586 - DNA, 21 bp, Artificial Sequence
  Description of Artificial Sequence: Synthetic oligonucleotide
  Description of Combined DNA/RNA Molecule: Synthetic oligonucleotide
aaagugugauccaagcugutt

SEQ ID NO: 1587 - DNA, 21 bp, Artificial Sequence
  Description of Artificial Sequence: Synthetic oligonucleotide
  Description of Combined DNA/RNA Molecule: Synthetic oligonucleotide
acagcuuggaucacacuuutt

SEQ ID NO: 1588 - DNA, 21 bp, Artificial Sequence
  Description of Artificial Sequence: Synthetic oligonucleotide
  Description of Combined DNA/RNA Molecule: Synthetic oligonucleotide
ugugauccaagcugucccatt

SEQ ID NO: 1589 - DNA, 21 bp, Artificial Sequence
  Description of Artificial Sequence: Synthetic oligonucleotide
  Description of Combined DNA/RNA Molecule: Synthetic oligonucleotide
ugggacagcuuggaucacatt

SEQ ID NO: 1590 - DNA, 21 bp, Artificial Sequence
  Description of Artificial Sequence: Synthetic oligonucleotide
  Description of Combined DNA/RNA Molecule: Synthetic oligonucleotide
gugauccaagcugucccaatt

SEQ ID NO: 1591 - DNA, 21 bp, Artificial Sequence
  Description of Artificial Sequence: Synthetic oligonucleotide
  Description of Combined DNA/RNA Molecule: Synthetic oligonucleotide
uugggacagcuuggaucactt

SEQ ID NO: 1592 - DNA, 21 bp, Artificial Sequence
  Description of Artificial Sequence: Synthetic oligonucleotide
  Description of Combined DNA/RNA Molecule: Synthetic oligonucleotide
gauccaagcugucccaaugtt

SEQ ID NO: 1593 - DNA, 21 bp, Artificial Sequence
  Description of Artificial Sequence: Synthetic oligonucleotide
  Description of Combined DNA/RNA Molecule: Synthetic oligonucleotide
cauugggacagcuuggauctt

SEQ ID NO: 1594 - DNA, 21 bp, Artificial Sequence
  Description of Artificial Sequence: Synthetic oligonucleotide
  Description of Combined DNA/RNA Molecule: Synthetic oligonucleotide
auccaagcugucccaauggtt

SEQ ID NO: 1595 - DNA, 21 bp, Artificial Sequence
  Description of Artificial Sequence: Synthetic oligonucleotide
  Description of Combined DNA/RNA Molecule: Synthetic oligonucleotide
ccauugggacagcuuggautt

SEQ ID NO: 1596 - DNA, 21 bp, Artificial Sequence
  Description of Artificial Sequence: Synthetic oligonucleotide
  Description of Combined DNA/RNA Molecule: Synthetic oligonucleotide
uccaagcugucccaaugggtt

SEQ ID NO: 1597 - DNA, 21 bp, Artificial Sequence
  Description of Artificial Sequence: Synthetic oligonucleotide
  Description of Combined DNA/RNA Molecule: Synthetic oligonucleotide
cccauugggacagcuuggatt

SEQ ID NO: 1598 - DNA, 21 bp, Artificial Sequence
  Description of Artificial Sequence: Synthetic oligonucleotide
  Description of Combined DNA/RNA Molecule: Synthetic oligonucleotide
ccaagcugucccaaugggatt

SEQ ID NO: 1599 - DNA, 21 bp, Artificial Sequence
  Description of Artificial Sequence: Synthetic oligonucleotide
  Description of Combined DNA/RNA Molecule: Synthetic oligonucleotide
ucccauugggacagcuuggtt

SEQ ID NO: 1600 - DNA, 21 bp, Artificial Sequence
  Description of Artificial Sequence: Synthetic oligonucleotide
  Description of Combined DNA/RNA Molecule: Synthetic oligonucleotide
caagcugucccaaugggagtt

SEQ ID NO: 1601 - DNA, 21 bp, Artificial Sequence
  Description of Artificial Sequence: Synthetic oligonucleotide
  Description of Combined DNA/RNA Molecule: Synthetic oligonucleotide
cucccauugggacagcuugtt

SEQ ID NO: 1602 - DNA, 21 bp, Artificial Sequence
  Description of Artificial Sequence: Synthetic oligonucleotide
  Description of Combined DNA/RNA Molecule: Synthetic oligonucleotide
agcugucccaaugggagcutt

SEQ ID NO: 1603 - DNA, 21 bp, Artificial Sequence
  Description of Artificial Sequence: Synthetic oligonucleotide
  Description of Combined DNA/RNA Molecule: Synthetic oligonucleotide
agcucccauugggacagcutt

SEQ ID NO: 1604 - DNA, 21 bp, Artificial Sequence
  Description of Artificial Sequence: Synthetic oligonucleotide
  Description of Combined DNA/RNA Molecule: Synthetic oligonucleotide
ugucccaaugggagcugcutt

SEQ ID NO: 1605 - DNA, 21 bp, Artificial Sequence
  Description of Artificial Sequence: Synthetic oligonucleotide
  Description of Combined DNA/RNA Molecule: Synthetic oligonucleotide
agcagcucccauugggacatt

SEQ ID NO: 1606 - DNA, 21 bp, Artificial Sequence
  Description of Artificial Sequence: Synthetic oligonucleotide
  Description of Combined DNA/RNA Molecule: Synthetic oligonucleotide
ggugcaggagaggagaacutt

SEQ ID NO: 1607 - DNA, 21 bp, Artificial Sequence
  Description of Artificial Sequence: Synthetic oligonucleotide
  Description of Combined DNA/RNA Molecule: Synthetic oligonucleotide
aguucuccucuccugcacctt

SEQ ID NO: 1608 - DNA, 21 bp, Artificial Sequence
  Description of Artificial Sequence: Synthetic oligonucleotide
  Description of Combined DNA/RNA Molecule: Synthetic oligonucleotide
aaacugaccaaaaucaucutt

SEQ ID NO: 1609 - DNA, 21 bp, Artificial Sequence
  Description of Artificial Sequence: Synthetic oligonucleotide
  Description of Combined DNA/RNA Molecule: Synthetic oligonucleotide
agaugauuuuggucaguuutt

SEQ ID NO: 1610 - DNA, 21 bp, Artificial Sequence
  Description of Artificial Sequence: Synthetic oligonucleotide
  Description of Combined DNA/RNA Molecule: Synthetic oligonucleotide
aacugaccaaaaucaucugtt

SEQ ID NO: 1611 - DNA, 21 bp, Artificial Sequence
  Description of Artificial Sequence: Synthetic oligonucleotide
  Description of Combined DNA/RNA Molecule: Synthetic oligonucleotide
cagaugauuuuggucaguutt

SEQ ID NO: 1612 - DNA, 21 bp, Artificial Sequence
  Description of Artificial Sequence: Synthetic oligonucleotide
  Description of Combined DNA/RNA Molecule: Synthetic oligonucleotide
acugaccaaaaucaucugutt

SEQ ID NO: 1613 - DNA, 21 bp, Artificial Sequence
  Description of Artificial Sequence: Synthetic oligonucleotide
  Description of Combined DNA/RNA Molecule: Synthetic oligonucleotide
acagaugauuuuggucagutt

SEQ ID NO: 1614 - DNA, 21 bp, Artificial Sequence
  Description of Artificial Sequence: Synthetic oligonucleotide
  Description of Combined DNA/RNA Molecule: Synthetic oligonucleotide
accaaaaucaucugugccctt

SEQ ID NO: 1615 - DNA, 21 bp, Artificial Sequence
  Description of Artificial Sequence: Synthetic oligonucleotide
  Description of Combined DNA/RNA Molecule: Synthetic oligonucleotide
gggcacagaugauuuuggutt

SEQ ID NO: 1616 - DNA, 21 bp, Artificial Sequence
  Description of Artificial Sequence: Synthetic oligonucleotide
  Description of Combined DNA/RNA Molecule: Synthetic oligonucleotide
ccaaaaucaucugugcccatt

SEQ ID NO: 1617 - DNA, 21 bp, Artificial Sequence
  Description of Artificial Sequence: Synthetic oligonucleotide
  Description of Combined DNA/RNA Molecule: Synthetic oligonucleotide
ugggcacagaugauuuuggtt

SEQ ID NO: 1618 - DNA, 21 bp, Artificial Sequence
  Description of Artificial Sequence: Synthetic oligonucleotide
  Description of Combined DNA/RNA Molecule: Synthetic oligonucleotide
aaaucaucugugcccagcatt

SEQ ID NO: 1619 - DNA, 21 bp, Artificial Sequence
  Description of Artificial Sequence: Synthetic oligonucleotide
  Description of Combined DNA/RNA Molecule: Synthetic oligonucleotide
ugcugggcacagaugauuutt

SEQ ID NO: 1620 - DNA, 21 bp, Artificial Sequence
  Description of Artificial Sequence: Synthetic oligonucleotide
  Description of Combined DNA/RNA Molecule: Synthetic oligonucleotide
gugcccagcagugcuccggtt

SEQ ID NO: 1621 - DNA, 21 bp, Artificial Sequence
  Description of Artificial Sequence: Synthetic oligonucleotide
  Description of Combined DNA/RNA Molecule: Synthetic oligonucleotide
ccggagcacugcugggcactt

SEQ ID NO: 1622 - DNA, 21 bp, Artificial Sequence
  Description of Artificial Sequence: Synthetic oligonucleotide
  Description of Combined DNA/RNA Molecule: Synthetic oligonucleotide
gcccagcagugcuccgggctt

SEQ ID NO: 1623 - DNA, 21 bp, Artificial Sequence
  Description of Artificial Sequence: Synthetic oligonucleotide
  Description of Combined DNA/RNA Molecule: Synthetic oligonucleotide
gcccggagcacugcugggctt

SEQ ID NO: 1624 - DNA, 21 bp, Artificial Sequence
  Description of Artificial Sequence: Synthetic oligonucleotide
  Description of Combined DNA/RNA Molecule: Synthetic oligonucleotide
ccagugacugcugccacaatt

SEQ ID NO: 1625 - DNA, 21 bp, Artificial Sequence
  Description of Artificial Sequence: Synthetic oligonucleotide
  Description of Combined DNA/RNA Molecule: Synthetic oligonucleotide
uuguggcagcagucacuggtt

SEQ ID NO: 1626 - DNA, 21 bp, Artificial Sequence
  Description of Artificial Sequence: Synthetic oligonucleotide
  Description of Combined DNA/RNA Molecule: Synthetic oligonucleotide
cagugacugcugccacaactt

SEQ ID NO: 1627 - DNA, 21 bp, Artificial Sequence
  Description of Artificial Sequence: Synthetic oligonucleotide
  Description of Combined DNA/RNA Molecule: Synthetic oligonucleotide
guuguggcagcagucacugtt

SEQ ID NO: 1628 - DNA, 21 bp, Artificial Sequence
  Description of Artificial Sequence: Synthetic oligonucleotide
  Description of Combined DNA/RNA Molecule: Synthetic oligonucleotide
gagagcgacugccuggucutt

SEQ ID NO: 1629 - DNA, 21 bp, Artificial Sequence
  Description of Artificial Sequence: Synthetic oligonucleotide
  Description of Combined DNA/RNA Molecule: Synthetic oligonucleotide
agaccaggcagucgcucuctt

SEQ ID NO: 1630 - DNA, 21 bp, Artificial Sequence
  Description of Artificial Sequence: Synthetic oligonucleotide
  Description of Combined DNA/RNA Molecule: Synthetic oligonucleotide
agagcgacugccuggucugtt

SEQ ID NO: 1631 - DNA, 21 bp, Artificial Sequence
  Description of Artificial Sequence: Synthetic oligonucleotide
  Description of Combined DNA/RNA Molecule: Synthetic oligonucleotide
cagaccaggcagucgcucutt

SEQ ID NO: 1632 - DNA, 21 bp, Artificial Sequence
  Description of Artificial Sequence: Synthetic oligonucleotide
  Description of Combined DNA/RNA Molecule: Synthetic oligonucleotide
gagcgacugccuggucugctt

SEQ ID NO: 1633 - DNA, 21 bp, Artificial Sequence
  Description of Artificial Sequence: Synthetic oligonucleotide
  Description of Combined DNA/RNA Molecule: Synthetic oligonucleotide
gcagaccaggcagucgcuctt

SEQ ID NO: 1634 - DNA, 21 bp, Artificial Sequence
  Description of Artificial Sequence: Synthetic oligonucleotide
  Description of Combined DNA/RNA Molecule: Synthetic oligonucleotide
agcgacugccuggucugcctt

SEQ ID NO: 1635 - DNA, 21 bp, Artificial Sequence
  Description of Artificial Sequence: Synthetic oligonucleotide
  Description of Combined DNA/RNA Molecule: Synthetic oligonucleotide
ggcagaccaggcagucgcutt

SEQ ID NO: 1636 - DNA, 21 bp, Artificial Sequence
  Description of Artificial Sequence: Synthetic oligonucleotide
  Description of Combined DNA/RNA Molecule: Synthetic oligonucleotide
gcgacugccuggucugccgtt

SEQ ID NO: 1637 - DNA, 21 bp, Artificial Sequence
  Description of Artificial Sequence: Synthetic oligonucleotide
  Description of Combined DNA/RNA Molecule: Synthetic oligonucleotide
cggcagaccaggcagucgctt

SEQ ID NO: 1638 - DNA, 21 bp, Artificial Sequence
  Description of Artificial Sequence: Synthetic oligonucleotide
  Description of Combined DNA/RNA Molecule: Synthetic oligonucleotide
cgacugccuggucugccgctt

SEQ ID NO: 1639 - DNA, 21 bp, Artificial Sequence
  Description of Artificial Sequence: Synthetic oligonucleotide
  Description of Combined DNA/RNA Molecule: Synthetic oligonucleotide
gcggcagaccaggcagucgtt

SEQ ID NO: 1640 - DNA, 21 bp, Artificial Sequence
  Description of Artificial Sequence: Synthetic oligonucleotide
  Description of Combined DNA/RNA Molecule: Synthetic oligonucleotide
gccuggucugccgcaaauutt

SEQ ID NO: 1641 - DNA, 21 bp, Artificial Sequence
  Description of Artificial Sequence: Synthetic oligonucleotide
  Description of Combined DNA/RNA Molecule: Synthetic oligonucleotide
aauuugcggcagaccaggctt

SEQ ID NO: 1642 - DNA, 21 bp, Artificial Sequence
  Description of Artificial Sequence: Synthetic oligonucleotide
  Description of Combined DNA/RNA Molecule: Synthetic oligonucleotide
ccuggucugccgcaaauuctt

SEQ ID NO: 1643 - DNA, 21 bp, Artificial Sequence
  Description of Artificial Sequence: Synthetic oligonucleotide
  Description of Combined DNA/RNA Molecule: Synthetic oligonucleotide
gaauuugcggcagaccaggtt

SEQ ID NO: 1644 - DNA, 21 bp, Artificial Sequence
  Description of Artificial Sequence: Synthetic oligonucleotide
  Description of Combined DNA/RNA Molecule: Synthetic oligonucleotide
cuggucugccgcaaauucctt

SEQ ID NO: 1645 - DNA, 21 bp, Artificial Sequence
  Description of Artificial Sequence: Synthetic oligonucleotide
  Description of Combined DNA/RNA Molecule: Synthetic oligonucleotide
ggaauuugcggcagaccagtt

SEQ ID NO: 1646 - DNA, 21 bp, Artificial Sequence
  Description of Artificial Sequence: Synthetic oligonucleotide
  Description of Combined DNA/RNA Molecule: Synthetic oligonucleotide
uggucugccgcaaauuccgtt

SEQ ID NO: 1647 - DNA, 21 bp, Artificial Sequence
  Description of Artificial Sequence: Synthetic oligonucleotide
  Description of Combined DNA/RNA Molecule: Synthetic oligonucleotide
cggaauuugcggcagaccatt

SEQ ID NO: 1648 - DNA, 21 bp, Artificial Sequence
  Description of Artificial Sequence: Synthetic oligonucleotide
  Description of Combined DNA/RNA Molecule: Synthetic oligonucleotide
gucugccgcaaauuccgagtt

SEQ ID NO: 1649 - DNA, 21 bp, Artificial Sequence
  Description of Artificial Sequence: Synthetic oligonucleotide
  Description of Combined DNA/RNA Molecule: Synthetic oligonucleotide
cucggaauuugcggcagactt

SEQ ID NO: 1650 - DNA, 21 bp, Artificial Sequence
  Description of Artificial Sequence: Synthetic oligonucleotide
  Description of Combined DNA/RNA Molecule: Synthetic oligonucleotide
ucugccgcaaauuccgagatt

SEQ ID NO: 1651 - DNA, 21 bp, Artificial Sequence
  Description of Artificial Sequence: Synthetic oligonucleotide
  Description of Combined DNA/RNA Molecule: Synthetic oligonucleotide
ucucggaauuugcggcagatt

SEQ ID NO: 1652 - DNA, 21 bp, Artificial Sequence
  Description of Artificial Sequence: Synthetic oligonucleotide
  Description of Combined DNA/RNA Molecule: Synthetic oligonucleotide
cugccgcaaauuccgagactt

SEQ ID NO: 1653 - DNA, 21 bp, Artificial Sequence
  Description of Artificial Sequence: Synthetic oligonucleotide
  Description of Combined DNA/RNA Molecule: Synthetic oligonucleotide
gucucggaauuugcggcagtt

SEQ ID NO: 1654 - DNA, 21 bp, Artificial Sequence
  Description of Artificial Sequence: Synthetic oligonucleotide
  Description of Combined DNA/RNA Molecule: Synthetic oligonucleotide
ugccgcaaauuccgagacgtt

SEQ ID NO: 1655 - DNA, 21 bp, Artificial Sequence
  Description of Artificial Sequence: Synthetic oligonucleotide
  Description of Combined DNA/RNA Molecule: Synthetic oligonucleotide
cgucucggaauuugcggcatt

SEQ ID NO: 1656 - DNA, 21 bp, Artificial Sequence
  Description of Artificial Sequence: Synthetic oligonucleotide
  Description of Combined DNA/RNA Molecule: Synthetic oligonucleotide
ccgcaaauuccgagacgaatt

SEQ ID NO: 1657 - DNA, 21 bp, Artificial Sequence
  Description of Artificial Sequence: Synthetic oligonucleotide
  Description of Combined DNA/RNA Molecule: Synthetic oligonucleotide
uucgucucggaauuugcggtt

SEQ ID NO: 1658 - DNA, 21 bp, Artificial Sequence
  Description of Artificial Sequence: Synthetic oligonucleotide
  Description of Combined DNA/RNA Molecule: Synthetic oligonucleotide
aauuccgagacgaagccactt

SEQ ID NO: 1659 - DNA, 21 bp, Artificial Sequence
  Description of Artificial Sequence: Synthetic oligonucleotide
  Description of Combined DNA/RNA Molecule: Synthetic oligonucleotide
guggcuucgucucggaauutt

SEQ ID NO: 1660 - DNA, 21 bp, Artificial Sequence
  Description of Artificial Sequence: Synthetic oligonucleotide
  Description of Combined DNA/RNA Molecule: Synthetic oligonucleotide
auuccgagacgaagccacgtt

SEQ ID NO: 1661 - DNA, 21 bp, Artificial Sequence
  Description of Artificial Sequence: Synthetic oligonucleotide
  Description of Combined DNA/RNA Molecule: Synthetic oligonucleotide
cguggcuucgucucggaautt

SEQ ID NO: 1662 - DNA, 21 bp, Artificial Sequence
  Description of Artificial Sequence: Synthetic oligonucleotide
  Description of Combined DNA/RNA Molecule: Synthetic oligonucleotide
uuccgagacgaagccacgutt

SEQ ID NO: 1663 - DNA, 21 bp, Artificial Sequence
  Description of Artificial Sequence: Synthetic oligonucleotide
  Description of Combined DNA/RNA Molecule: Synthetic oligonucleotide
acguggcuucgucucggaatt

SEQ ID NO: 1664 - DNA, 21 bp, Artificial Sequence
  Description of Artificial Sequence: Synthetic oligonucleotide
  Description of Combined DNA/RNA Molecule: Synthetic oligonucleotide
uccgagacgaagccacgugtt

SEQ ID NO: 1665 - DNA, 21 bp, Artificial Sequence
  Description of Artificial Sequence: Synthetic oligonucleotide
  Description of Combined DNA/RNA Molecule: Synthetic oligonucleotide
cacguggcuucgucucggatt

SEQ ID NO: 1666 - DNA, 21 bp, Artificial Sequence
  Description of Artificial Sequence: Synthetic oligonucleotide
  Description of Combined DNA/RNA Molecule: Synthetic oligonucleotide
ccgagacgaagccacgugctt

SEQ ID NO: 1667 - DNA, 21 bp, Artificial Sequence
  Description of Artificial Sequence: Synthetic oligonucleotide
  Description of Combined DNA/RNA Molecule: Synthetic oligonucleotide
gcacguggcuucgucucggtt

SEQ ID NO: 1668 - DNA, 21 bp, Artificial Sequence
  Description of Artificial Sequence: Synthetic oligonucleotide
  Description of Combined DNA/RNA Molecule: Synthetic oligonucleotide
gagacgaagccacgugcaatt

SEQ ID NO: 1669 - DNA, 21 bp, Artificial Sequence
  Description of Artificial Sequence: Synthetic oligonucleotide
  Description of Combined DNA/RNA Molecule: Synthetic oligonucleotide
uugcacguggcuucgucuctt

SEQ ID NO: 1670 - DNA, 21 bp, Artificial Sequence
  Description of Artificial Sequence: Synthetic oligonucleotide
  Description of Combined DNA/RNA Molecule: Synthetic oligonucleotide
acgaagccacgugcaaggatt

SEQ ID NO: 1671 - DNA, 21 bp, Artificial Sequence
  Description of Artificial Sequence: Synthetic oligonucleotide
  Description of Combined DNA/RNA Molecule: Synthetic oligonucleotide
uccuugcacguggcuucgutt

SEQ ID NO: 1672 - DNA, 21 bp, Artificial Sequence
  Description of Artificial Sequence: Synthetic oligonucleotide
  Description of Combined DNA/RNA Molecule: Synthetic oligonucleotide
cgaagccacgugcaaggactt

SEQ ID NO: 1673 - DNA, 21 bp, Artificial Sequence
  Description of Artificial Sequence: Synthetic oligonucleotide
  Description of Combined DNA/RNA Molecule: Synthetic oligonucleotide
guccuugcacguggcuucgtt

SEQ ID NO: 1674 - DNA, 21 bp, Artificial Sequence
  Description of Artificial Sequence: Synthetic oligonucleotide
  Description of Combined DNA/RNA Molecule: Synthetic oligonucleotide
gaagccacgugcaaggacatt

SEQ ID NO: 1675 - DNA, 21 bp, Artificial Sequence
  Description of Artificial Sequence: Synthetic oligonucleotide
  Description of Combined DNA/RNA Molecule: Synthetic oligonucleotide
uguccuugcacguggcuuctt

SEQ ID NO: 1676 - DNA, 21 bp, Artificial Sequence
  Description of Artificial Sequence: Synthetic oligonucleotide
  Description of Combined DNA/RNA Molecule: Synthetic oligonucleotide
aagccacgugcaaggacactt

SEQ ID NO: 1677 - DNA, 21 bp, Artificial Sequence
  Description of Artificial Sequence: Synthetic oligonucleotide
  Description of Combined DNA/RNA Molecule: Synthetic oligonucleotide
guguccuugcacguggcuutt

SEQ ID NO: 1678 - DNA, 21 bp, Artificial Sequence
  Description of Artificial Sequence: Synthetic oligonucleotide
  Description of Combined DNA/RNA Molecule: Synthetic oligonucleotide
ccccacucaugcucuacaatt

SEQ ID NO: 1679 - DNA, 21 bp, Artificial Sequence
  Description of Artificial Sequence: Synthetic oligonucleotide
  Description of Combined DNA/RNA Molecule: Synthetic oligonucleotide
uuguagagcaugaguggggtt

SEQ ID NO: 1680 - DNA, 21 bp, Artificial Sequence
  Description of Artificial Sequence: Synthetic oligonucleotide
  Description of Combined DNA/RNA Molecule: Synthetic oligonucleotide
ccacucaugcucuacaacctt

SEQ ID NO: 1681 - DNA, 21 bp, Artificial Sequence
  Description of Artificial Sequence: Synthetic oligonucleotide
  Description of Combined DNA/RNA Molecule: Synthetic oligonucleotide
gguuguagagcaugaguggtt

SEQ ID NO: 1682 - DNA, 21 bp, Artificial Sequence
  Description of Artificial Sequence: Synthetic oligonucleotide
  Description of Combined DNA/RNA Molecule: Synthetic oligonucleotide
acucaugcucuacaacccctt

SEQ ID NO: 1683 - DNA, 21 bp, Artificial Sequence
  Description of Artificial Sequence: Synthetic oligonucleotide
  Description of Combined DNA/RNA Molecule: Synthetic oligonucleotide
gggguuguagagcaugagutt

SEQ ID NO: 1684 - DNA, 21 bp, Artificial Sequence
  Description of Artificial Sequence: Synthetic oligonucleotide
  Description of Combined DNA/RNA Molecule: Synthetic oligonucleotide
caugcucuacaaccccacctt

SEQ ID NO: 1685 - DNA, 21 bp, Artificial Sequence
  Description of Artificial Sequence: Synthetic oligonucleotide
  Description of Combined DNA/RNA Molecule: Synthetic oligonucleotide
ggugggguuguagagcaugtt

SEQ ID NO: 1686 - DNA, 21 bp, Artificial Sequence
  Description of Artificial Sequence: Synthetic oligonucleotide
  Description of Combined DNA/RNA Molecule: Synthetic oligonucleotide
ccagauggaugugaacccctt

SEQ ID NO: 1687 - DNA, 21 bp, Artificial Sequence
  Description of Artificial Sequence: Synthetic oligonucleotide
  Description of Combined DNA/RNA Molecule: Synthetic oligonucleotide
gggguucacauccaucuggtt

SEQ ID NO: 1688 - DNA, 21 bp, Artificial Sequence
  Description of Artificial Sequence: Synthetic oligonucleotide
  Description of Combined DNA/RNA Molecule: Synthetic oligonucleotide
agauggaugugaaccccgatt

SEQ ID NO: 1689 - DNA, 21 bp, Artificial Sequence
  Description of Artificial Sequence: Synthetic oligonucleotide
  Description of Combined DNA/RNA Molecule: Synthetic oligonucleotide
ucgggguucacauccaucutt

SEQ ID NO: 1690 - DNA, 21 bp, Artificial Sequence
  Description of Artificial Sequence: Synthetic oligonucleotide
  Description of Combined DNA/RNA Molecule: Synthetic oligonucleotide
gauggaugugaaccccgagtt

SEQ ID NO: 1691 - DNA, 21 bp, Artificial Sequence
  Description of Artificial Sequence: Synthetic oligonucleotide
  Description of Combined DNA/RNA Molecule: Synthetic oligonucleotide
cucgggguucacauccauctt

SEQ ID NO: 1692 - DNA, 21 bp, Artificial Sequence
  Description of Artificial Sequence: Synthetic oligonucleotide
  Description of Combined DNA/RNA Molecule: Synthetic oligonucleotide
auggaugugaaccccgaggtt

SEQ ID NO: 1693 - DNA, 21 bp, Artificial Sequence
  Description of Artificial Sequence: Synthetic oligonucleotide
  Description of Combined DNA/RNA Molecule: Synthetic oligonucleotide
ccucgggguucacauccautt

SEQ ID NO: 1694 - DNA, 21 bp, Artificial Sequence
  Description of Artificial Sequence: Synthetic oligonucleotide
  Description of Combined DNA/RNA Molecule: Synthetic oligonucleotide
ggaugugaaccccgagggctt

SEQ ID NO: 1695 - DNA, 21 bp, Artificial Sequence
  Description of Artificial Sequence: Synthetic oligonucleotide
  Description of Combined DNA/RNA Molecule: Synthetic oligonucleotide
gcccucgggguucacaucctt

SEQ ID NO: 1696 - DNA, 21 bp, Artificial Sequence
  Description of Artificial Sequence: Synthetic oligonucleotide
  Description of Combined DNA/RNA Molecule: Synthetic oligonucleotide
gaugugaaccccgagggcatt

SEQ ID NO: 1697 - DNA, 21 bp, Artificial Sequence
  Description of Artificial Sequence: Synthetic oligonucleotide
  Description of Combined DNA/RNA Molecule: Synthetic oligonucleotide
ugcccucgggguucacauctt

SEQ ID NO: 1698 - DNA, 21 bp, Artificial Sequence
  Description of Artificial Sequence: Synthetic oligonucleotide
  Description of Combined DNA/RNA Molecule: Synthetic oligonucleotide
ugugaaccccgagggcaaatt

SEQ ID NO: 1699 - DNA, 21 bp, Artificial Sequence
  Description of Artificial Sequence: Synthetic oligonucleotide
  Description of Combined DNA/RNA Molecule: Synthetic oligonucleotide
uuugcccucgggguucacatt

SEQ ID NO: 1700 - DNA, 21 bp, Artificial Sequence
  Description of Artificial Sequence: Synthetic oligonucleotide
  Description of Combined DNA/RNA Molecule: Synthetic oligonucleotide
aaccccgagggcaaauacatt

SEQ ID NO: 1701 - DNA, 21 bp, Artificial Sequence
  Description of Artificial Sequence: Synthetic oligonucleotide
  Description of Combined DNA/RNA Molecule: Synthetic oligonucleotide
uguauuugcccucgggguutt

SEQ ID NO: 1702 - DNA, 21 bp, Artificial Sequence
  Description of Artificial Sequence: Synthetic oligonucleotide
  Description of Combined DNA/RNA Molecule: Synthetic oligonucleotide
accccgagggcaaauacagtt

SEQ ID NO: 1703 - DNA, 21 bp, Artificial Sequence
  Description of Artificial Sequence: Synthetic oligonucleotide
  Description of Combined DNA/RNA Molecule: Synthetic oligonucleotide
cuguauuugcccucggggutt

SEQ ID NO: 1704 - DNA, 21 bp, Artificial Sequence
  Description of Artificial Sequence: Synthetic oligonucleotide
  Description of Combined DNA/RNA Molecule: Synthetic oligonucleotide
cccgagggcaaauacagcutt

SEQ ID NO: 1705 - DNA, 21 bp, Artificial Sequence
  Description of Artificial Sequence: Synthetic oligonucleotide
  Description of Combined DNA/RNA Molecule: Synthetic oligonucleotide
agcuguauuugcccucgggtt

SEQ ID NO: 1706 - DNA, 21 bp, Artificial Sequence
  Description of Artificial Sequence: Synthetic oligonucleotide
  Description of Combined DNA/RNA Molecule: Synthetic oligonucleotide
ccgagggcaaauacagcuutt

SEQ ID NO: 1707 - DNA, 21 bp, Artificial Sequence
  Description of Artificial Sequence: Synthetic oligonucleotide
  Description of Combined DNA/RNA Molecule: Synthetic oligonucleotide
aagcuguauuugcccucggtt

SEQ ID NO: 1708 - DNA, 21 bp, Artificial Sequence
  Description of Artificial Sequence: Synthetic oligonucleotide
  Description of Combined DNA/RNA Molecule: Synthetic oligonucleotide
cgagggcaaauacagcuuutt

SEQ ID NO: 1709 - DNA, 21 bp, Artificial Sequence
  Description of Artificial Sequence: Synthetic oligonucleotide
  Description of Combined DNA/RNA Molecule: Synthetic oligonucleotide
aaagcuguauuugcccucgtt

SEQ ID NO: 1710 - DNA, 21 bp, Artificial Sequence
  Description of Artificial Sequence: Synthetic oligonucleotide
  Description of Combined DNA/RNA Molecule: Synthetic oligonucleotide
aaauacagcuuuggugccatt

SEQ ID NO: 1711 - DNA, 21 bp, Artificial Sequence
  Description of Artificial Sequence: Synthetic oligonucleotide
  Description of Combined DNA/RNA Molecule: Synthetic oligonucleotide
uggcaccaaagcuguauuutt

SEQ ID NO: 1712 - DNA, 21 bp, Artificial Sequence
  Description of Artificial Sequence: Synthetic oligonucleotide
  Description of Combined DNA/RNA Molecule: Synthetic oligonucleotide
aauacagcuuuggugccactt

SEQ ID NO: 1713 - DNA, 21 bp, Artificial Sequence
  Description of Artificial Sequence: Synthetic oligonucleotide
  Description of Combined DNA/RNA Molecule: Synthetic oligonucleotide
guggcaccaaagcuguauutt

SEQ ID NO: 1714 - DNA, 21 bp, Artificial Sequence
  Description of Artificial Sequence: Synthetic oligonucleotide
  Description of Combined DNA/RNA Molecule: Synthetic oligonucleotide
auacagcuuuggugccacctt

SEQ ID NO: 1715 - DNA, 21 bp, Artificial Sequence
  Description of Artificial Sequence: Synthetic oligonucleotide
  Description of Combined DNA/RNA Molecule: Synthetic oligonucleotide
gguggcaccaaagcuguautt

SEQ ID NO: 1716 - DNA, 21 bp, Artificial Sequence
  Description of Artificial Sequence: Synthetic oligonucleotide
  Description of Combined DNA/RNA Molecule: Synthetic oligonucleotide
cuuuggugccaccugcgugtt

SEQ ID NO: 1717 - DNA, 21 bp, Artificial Sequence
  Description of Artificial Sequence: Synthetic oligonucleotide
  Description of Combined DNA/RNA Molecule: Synthetic oligonucleotide
cacgcagguggcaccaaagtt

SEQ ID NO: 1718 - DNA, 21 bp, Artificial Sequence
  Description of Artificial Sequence: Synthetic oligonucleotide
  Description of Combined DNA/RNA Molecule: Synthetic oligonucleotide
uuggugccaccugcgugaatt

SEQ ID NO: 1719 - DNA, 21 bp, Artificial Sequence
  Description of Artificial Sequence: Synthetic oligonucleotide
  Description of Combined DNA/RNA Molecule: Synthetic oligonucleotide
uucacgcagguggcaccaatt

SEQ ID NO: 1720 - DNA, 21 bp, Artificial Sequence
  Description of Artificial Sequence: Synthetic oligonucleotide
  Description of Combined DNA/RNA Molecule: Synthetic oligonucleotide
ccaccugcgugaagaagugtt

SEQ ID NO: 1721 - DNA, 21 bp, Artificial Sequence
  Description of Artificial Sequence: Synthetic oligonucleotide
  Description of Combined DNA/RNA Molecule: Synthetic oligonucleotide
cacuucuucacgcagguggtt

SEQ ID NO: 1722 - DNA, 21 bp, Artificial Sequence
  Description of Artificial Sequence: Synthetic oligonucleotide
  Description of Combined DNA/RNA Molecule: Synthetic oligonucleotide
cugcgugaagaaguguccctt

SEQ ID NO: 1723 - DNA, 21 bp, Artificial Sequence
  Description of Artificial Sequence: Synthetic oligonucleotide
  Description of Combined DNA/RNA Molecule: Synthetic oligonucleotide
gggacacuucuucacgcagtt

SEQ ID NO: 1724 - DNA, 21 bp, Artificial Sequence
  Description of Artificial Sequence: Synthetic oligonucleotide
  Description of Combined DNA/RNA Molecule: Synthetic oligonucleotide
ugcgugaagaagugucccctt

SEQ ID NO: 1725 - DNA, 21 bp, Artificial Sequence
  Description of Artificial Sequence: Synthetic oligonucleotide
  Description of Combined DNA/RNA Molecule: Synthetic oligonucleotide
ggggacacuucuucacgcatt

SEQ ID NO: 1726 - DNA, 21 bp, Artificial Sequence
  Description of Artificial Sequence: Synthetic oligonucleotide
  Description of Combined DNA/RNA Molecule: Synthetic oligonucleotide
gcgugaagaaguguccccgtt

SEQ ID NO: 1727 - DNA, 21 bp, Artificial Sequence
  Description of Artificial Sequence: Synthetic oligonucleotide
  Description of Combined DNA/RNA Molecule: Synthetic oligonucleotide
cggggacacuucuucacgctt

SEQ ID NO: 1728 - DNA, 21 bp, Artificial Sequence
  Description of Artificial Sequence: Synthetic oligonucleotide
  Description of Combined DNA/RNA Molecule: Synthetic oligonucleotide
cgugaagaaguguccccgutt

SEQ ID NO: 1729 - DNA, 21 bp, Artificial Sequence
  Description of Artificial Sequence: Synthetic oligonucleotide
  Description of Combined DNA/RNA Molecule: Synthetic oligonucleotide
acggggacacuucuucacgtt

SEQ ID NO: 1730 - DNA, 21 bp, Artificial Sequence
  Description of Artificial Sequence: Synthetic oligonucleotide
  Description of Combined DNA/RNA Molecule: Synthetic oligonucleotide
gugaagaaguguccccguatt

SEQ ID NO: 1731 - DNA, 21 bp, Artificial Sequence
  Description of Artificial Sequence: Synthetic oligonucleotide
  Description of Combined DNA/RNA Molecule: Synthetic oligonucleotide
uacggggacacuucuucactt

SEQ ID NO: 1732 - DNA, 21 bp, Artificial Sequence
  Description of Artificial Sequence: Synthetic oligonucleotide
  Description of Combined DNA/RNA Molecule: Synthetic oligonucleotide
ugaagaaguguccccguaatt

SEQ ID NO: 1733 - DNA, 21 bp, Artificial Sequence
  Description of Artificial Sequence: Synthetic oligonucleotide
  Description of Combined DNA/RNA Molecule: Synthetic oligonucleotide
uuacggggacacuucuucatt

SEQ ID NO: 1734 - DNA, 21 bp, Artificial Sequence
  Description of Artificial Sequence: Synthetic oligonucleotide
  Description of Combined DNA/RNA Molecule: Synthetic oligonucleotide
gaagaaguguccccguaautt

SEQ ID NO: 1735 - DNA, 21 bp, Artificial Sequence
  Description of Artificial Sequence: Synthetic oligonucleotide
  Description of Combined DNA/RNA Molecule: Synthetic oligonucleotide
auuacggggacacuucuuctt

SEQ ID NO: 1736 - DNA, 21 bp, Artificial Sequence
  Description of Artificial Sequence: Synthetic oligonucleotide
  Description of Combined DNA/RNA Molecule: Synthetic oligonucleotide
aagaaguguccccguaauutt

SEQ ID NO: 1737 - DNA, 21 bp, Artificial Sequence
  Description of Artificial Sequence: Synthetic oligonucleotide
  Description of Combined DNA/RNA Molecule: Synthetic oligonucleotide
aauuacggggacacuucuutt

SEQ ID NO: 1738 - DNA, 21 bp, Artificial Sequence
  Description of Artificial Sequence: Synthetic oligonucleotide
  Description of Combined DNA/RNA Molecule: Synthetic oligonucleotide
agaaguguccccguaauuatt

SEQ ID NO: 1739 - DNA, 21 bp, Artificial Sequence
  Description of Artificial Sequence: Synthetic oligonucleotide
  Description of Combined DNA/RNA Molecule: Synthetic oligonucleotide
uaauuacggggacacuucutt

SEQ ID NO: 1740 - DNA, 21 bp, Artificial Sequence
  Description of Artificial Sequence: Synthetic oligonucleotide
  Description of Combined DNA/RNA Molecule: Synthetic oligonucleotide
gaaguguccccguaauuautt

SEQ ID NO: 1741 - DNA, 21 bp, Artificial Sequence
  Description of Artificial Sequence: Synthetic oligonucleotide
  Description of Combined DNA/RNA Molecule: Synthetic oligonucleotide
auaauuacggggacacuuctt

SEQ ID NO: 1742 - DNA, 21 bp, Artificial Sequence
  Description of Artificial Sequence: Synthetic oligonucleotide
  Description of Combined DNA/RNA Molecule: Synthetic oligonucleotide
aaguguccccguaauuaugtt

SEQ ID NO: 1743 - DNA, 21 bp, Artificial Sequence
  Description of Artificial Sequence: Synthetic oligonucleotide
  Description of Combined DNA/RNA Molecule: Synthetic oligonucleotide
cauaauuacggggacacuutt

SEQ ID NO: 1744 - DNA, 21 bp, Artificial Sequence
  Description of Artificial Sequence: Synthetic oligonucleotide
  Description of Combined DNA/RNA Molecule: Synthetic oligonucleotide
aguguccccguaauuaugutt

SEQ ID NO: 1745 - DNA, 21 bp, Artificial Sequence
  Description of Artificial Sequence: Synthetic oligonucleotide
  Description of Combined DNA/RNA Molecule: Synthetic oligonucleotide
acauaauuacggggacacutt

SEQ ID NO: 1746 - DNA, 21 bp, Artificial Sequence
  Description of Artificial Sequence: Synthetic oligonucleotide
  Description of Combined DNA/RNA Molecule: Synthetic oligonucleotide
guguccccguaauuaugugtt

SEQ ID NO: 1747 - DNA, 21 bp, Artificial Sequence
  Description of Artificial Sequence: Synthetic oligonucleotide
  Description of Combined DNA/RNA Molecule: Synthetic oligonucleotide
cacauaauuacggggacactt

SEQ ID NO: 1748 - DNA, 21 bp, Artificial Sequence
  Description of Artificial Sequence: Synthetic oligonucleotide
  Description of Combined DNA/RNA Molecule: Synthetic oligonucleotide
uguccccguaauuauguggtt

SEQ ID NO: 1749 - DNA, 21 bp, Artificial Sequence
  Description of Artificial Sequence: Synthetic oligonucleotide
  Description of Combined DNA/RNA Molecule: Synthetic oligonucleotide
ccacauaauuacggggacatt

SEQ ID NO: 1750 - DNA, 21 bp, Artificial Sequence
  Description of Artificial Sequence: Synthetic oligonucleotide
  Description of Combined DNA/RNA Molecule: Synthetic oligonucleotide
guccccguaauuauguggutt

SEQ ID NO: 1751 - DNA, 21 bp, Artificial Sequence
  Description of Artificial Sequence: Synthetic oligonucleotide
  Description of Combined DNA/RNA Molecule: Synthetic oligonucleotide
accacauaauuacggggactt

SEQ ID NO: 1752 - DNA, 21 bp, Artificial Sequence
  Description of Artificial Sequence: Synthetic oligonucleotide
  Description of Combined DNA/RNA Molecule: Synthetic oligonucleotide
ccccguaauuauguggugatt

SEQ ID NO: 1753 - DNA, 21 bp, Artificial Sequence
  Description of Artificial Sequence: Synthetic oligonucleotide
  Description of Combined DNA/RNA Molecule: Synthetic oligonucleotide
ucaccacauaauuacggggtt

SEQ ID NO: 1754 - DNA, 21 bp, Artificial Sequence
  Description of Artificial Sequence: Synthetic oligonucleotide
  Description of Combined DNA/RNA Molecule: Synthetic oligonucleotide
ccguaauuauguggugacatt

SEQ ID NO: 1755 - DNA, 21 bp, Artificial Sequence
  Description of Artificial Sequence: Synthetic oligonucleotide
  Description of Combined DNA/RNA Molecule: Synthetic oligonucleotide
ugucaccacauaauuacggtt

SEQ ID NO: 1756 - DNA, 21 bp, Artificial Sequence
  Description of Artificial Sequence: Synthetic oligonucleotide
  Description of Combined DNA/RNA Molecule: Synthetic oligonucleotide
guaauuauguggugacagatt

SEQ ID NO: 1757 - DNA, 21 bp, Artificial Sequence
  Description of Artificial Sequence: Synthetic oligonucleotide
  Description of Combined DNA/RNA Molecule: Synthetic oligonucleotide
ucugucaccacauaauuactt

SEQ ID NO: 1758 - DNA, 21 bp, Artificial Sequence
  Description of Artificial Sequence: Synthetic oligonucleotide
  Description of Combined DNA/RNA Molecule: Synthetic oligonucleotide
uaauuauguggugacagautt

SEQ ID NO: 1759 - DNA, 21 bp, Artificial Sequence
  Description of Artificial Sequence: Synthetic oligonucleotide
  Description of Combined DNA/RNA Molecule: Synthetic oligonucleotide
aucugucaccacauaauuatt

SEQ ID NO: 1760 - DNA, 21 bp, Artificial Sequence
  Description of Artificial Sequence: Synthetic oligonucleotide
  Description of Combined DNA/RNA Molecule: Synthetic oligonucleotide
aauuauguggugacagauctt

SEQ ID NO: 1761 - DNA, 21 bp, Artificial Sequence
  Description of Artificial Sequence: Synthetic oligonucleotide
  Description of Combined DNA/RNA Molecule: Synthetic oligonucleotide
gaucugucaccacauaauutt

SEQ ID NO: 1762 - DNA, 21 bp, Artificial Sequence
  Description of Artificial Sequence: Synthetic oligonucleotide
  Description of Combined DNA/RNA Molecule: Synthetic oligonucleotide
auuauguggugacagaucatt

SEQ ID NO: 1763 - DNA, 21 bp, Artificial Sequence
  Description of Artificial Sequence: Synthetic oligonucleotide
  Description of Combined DNA/RNA Molecule: Synthetic oligonucleotide
ugaucugucaccacauaautt

SEQ ID NO: 1764 - DNA, 21 bp, Artificial Sequence
  Description of Artificial Sequence: Synthetic oligonucleotide
  Description of Combined DNA/RNA Molecule: Synthetic oligonucleotide
uuauguggugacagaucactt

SEQ ID NO: 1765 - DNA, 21 bp, Artificial Sequence
  Description of Artificial Sequence: Synthetic oligonucleotide
  Description of Combined DNA/RNA Molecule: Synthetic oligonucleotide
gugaucugucaccacauaatt

SEQ ID NO: 1766 - DNA, 21 bp, Artificial Sequence
  Description of Artificial Sequence: Synthetic oligonucleotide
  Description of Combined DNA/RNA Molecule: Synthetic oligonucleotide
auguggugacagaucacggtt

SEQ ID NO: 1767 - DNA, 21 bp, Artificial Sequence
  Description of Artificial Sequence: Synthetic oligonucleotide
  Description of Combined DNA/RNA Molecule: Synthetic oligonucleotide
ccgugaucugucaccacautt

SEQ ID NO: 1768 - DNA, 21 bp, Artificial Sequence
  Description of Artificial Sequence: Synthetic oligonucleotide
  Description of Combined DNA/RNA Molecule: Synthetic oligonucleotide
uggugacagaucacggcuctt

SEQ ID NO: 1769 - DNA, 21 bp, Artificial Sequence
  Description of Artificial Sequence: Synthetic oligonucleotide
  Description of Combined DNA/RNA Molecule: Synthetic oligonucleotide
gagccgugaucugucaccatt

SEQ ID NO: 1770 - DNA, 21 bp, Artificial Sequence
  Description of Artificial Sequence: Synthetic oligonucleotide
  Description of Combined DNA/RNA Molecule: Synthetic oligonucleotide
gugacagaucacggcucgutt

SEQ ID NO: 1771 - DNA, 21 bp, Artificial Sequence
  Description of Artificial Sequence: Synthetic oligonucleotide
  Description of Combined DNA/RNA Molecule: Synthetic oligonucleotide
acgagccgugaucugucactt

SEQ ID NO: 1772 - DNA, 21 bp, Artificial Sequence
  Description of Artificial Sequence: Synthetic oligonucleotide
  Description of Combined DNA/RNA Molecule: Synthetic oligonucleotide
ugacagaucacggcucgugtt

SEQ ID NO: 1773 - DNA, 21 bp, Artificial Sequence
  Description of Artificial Sequence: Synthetic oligonucleotide
  Description of Combined DNA/RNA Molecule: Synthetic oligonucleotide
cacgagccgugaucugucatt

SEQ ID NO: 1774 - DNA, 21 bp, Artificial Sequence
  Description of Artificial Sequence: Synthetic oligonucleotide
  Description of Combined DNA/RNA Molecule: Synthetic oligonucleotide
gacagaucacggcucgugctt

SEQ ID NO: 1775 - DNA, 21 bp, Artificial Sequence
  Description of Artificial Sequence: Synthetic oligonucleotide
  Description of Combined DNA/RNA Molecule: Synthetic oligonucleotide
gcacgagccgugaucuguctt

SEQ ID NO: 1776 - DNA, 21 bp, Artificial Sequence
  Description of Artificial Sequence: Synthetic oligonucleotide
  Description of Combined DNA/RNA Molecule: Synthetic oligonucleotide
acagaucacggcucgugcgtt

SEQ ID NO: 1777 - DNA, 21 bp, Artificial Sequence
  Description of Artificial Sequence: Synthetic oligonucleotide
  Description of Combined DNA/RNA Molecule: Synthetic oligonucleotide
cgcacgagccgugaucugutt

SEQ ID NO: 1778 - DNA, 21 bp, Artificial Sequence
  Description of Artificial Sequence: Synthetic oligonucleotide
  Description of Combined DNA/RNA Molecule: Synthetic oligonucleotide
cagaucacggcucgugcgutt

SEQ ID NO: 1779 - DNA, 21 bp, Artificial Sequence
  Description of Artificial Sequence: Synthetic oligonucleotide
  Description of Combined DNA/RNA Molecule: Synthetic oligonucleotide
acgcacgagccgugaucugtt

SEQ ID NO: 1780 - DNA, 21 bp, Artificial Sequence
  Description of Artificial Sequence: Synthetic oligonucleotide
  Description of Combined DNA/RNA Molecule: Synthetic oligonucleotide
agaucacggcucgugcguctt

SEQ ID NO: 1781 - DNA, 21 bp, Artificial Sequence
  Description of Artificial Sequence: Synthetic oligonucleotide
  Description of Combined DNA/RNA Molecule: Synthetic oligonucleotide
gacgcacgagccgugaucutt

SEQ ID NO: 1782 - DNA, 21 bp, Artificial Sequence
  Description of Artificial Sequence: Synthetic oligonucleotide
  Description of Combined DNA/RNA Molecule: Synthetic oligonucleotide
gaucacggcucgugcgucctt

SEQ ID NO: 1783 - DNA, 21 bp, Artificial Sequence
  Description of Artificial Sequence: Synthetic oligonucleotide
  Description of Combined DNA/RNA Molecule: Synthetic oligonucleotide
ggacgcacgagccgugauctt

SEQ ID NO: 1784 - DNA, 21 bp, Artificial Sequence
  Description of Artificial Sequence: Synthetic oligonucleotide
  Description of Combined DNA/RNA Molecule: Synthetic oligonucleotide
aucacggcucgugcguccgtt

SEQ ID NO: 1785 - DNA, 21 bp, Artificial Sequence
  Description of Artificial Sequence: Synthetic oligonucleotide
  Description of Combined DNA/RNA Molecule: Synthetic oligonucleotide
cggacgcacgagccgugautt

SEQ ID NO: 1786 - DNA, 21 bp, Artificial Sequence
  Description of Artificial Sequence: Synthetic oligonucleotide
  Description of Combined DNA/RNA Molecule: Synthetic oligonucleotide
ucacggcucgugcguccgatt

SEQ ID NO: 1787 - DNA, 21 bp, Artificial Sequence
  Description of Artificial Sequence: Synthetic oligonucleotide
  Description of Combined DNA/RNA Molecule: Synthetic oligonucleotide
ucggacgcacgagccgugatt

SEQ ID NO: 1788 - DNA, 21 bp, Artificial Sequence
  Description of Artificial Sequence: Synthetic oligonucleotide
  Description of Combined DNA/RNA Molecule: Synthetic oligonucleotide
cacggcucgugcguccgagtt

SEQ ID NO: 1789 - DNA, 21 bp, Artificial Sequence
  Description of Artificial Sequence: Synthetic oligonucleotide
  Description of Combined DNA/RNA Molecule: Synthetic oligonucleotide
cucggacgcacgagccgugtt

SEQ ID NO: 1790 - DNA, 21 bp, Artificial Sequence
  Description of Artificial Sequence: Synthetic oligonucleotide
  Description of Combined DNA/RNA Molecule: Synthetic oligonucleotide
acggcucgugcguccgagctt

SEQ ID NO: 1791 - DNA, 21 bp, Artificial Sequence
  Description of Artificial Sequence: Synthetic oligonucleotide
  Description of Combined DNA/RNA Molecule: Synthetic oligonucleotide
gcucggacgcacgagccgutt

SEQ ID NO: 1792 - DNA, 21 bp, Artificial Sequence
  Description of Artificial Sequence: Synthetic oligonucleotide
  Description of Combined DNA/RNA Molecule: Synthetic oligonucleotide
gcucgugcguccgagccugtt

SEQ ID NO: 1793 - DNA, 21 bp, Artificial Sequence
  Description of Artificial Sequence: Synthetic oligonucleotide
  Description of Combined DNA/RNA Molecule: Synthetic oligonucleotide
caggcucggacgcacgagctt

SEQ ID NO: 1794 - DNA, 21 bp, Artificial Sequence
  Description of Artificial Sequence: Synthetic oligonucleotide
  Description of Combined DNA/RNA Molecule: Synthetic oligonucleotide
ggaggaagacggcguccgctt

SEQ ID NO: 1795 - DNA, 21 bp, Artificial Sequence
  Description of Artificial Sequence: Synthetic oligonucleotide
  Description of Combined DNA/RNA Molecule: Synthetic oligonucleotide
gcggacgccgucuuccucctt

SEQ ID NO: 1796 - DNA, 21 bp, Artificial Sequence
  Description of Artificial Sequence: Synthetic oligonucleotide
  Description of Combined DNA/RNA Molecule: Synthetic oligonucleotide
gaggaagacggcguccgcatt

SEQ ID NO: 1797 - DNA, 21 bp, Artificial Sequence
  Description of Artificial Sequence: Synthetic oligonucleotide
  Description of Combined DNA/RNA Molecule: Synthetic oligonucleotide
ugcggacgccgucuuccuctt

SEQ ID NO: 1798 - DNA, 21 bp, Artificial Sequence
  Description of Artificial Sequence: Synthetic oligonucleotide
  Description of Combined DNA/RNA Molecule: Synthetic oligonucleotide
ggaagacggcguccgcaagtt

SEQ ID NO: 1799 - DNA, 21 bp, Artificial Sequence
  Description of Artificial Sequence: Synthetic oligonucleotide
  Description of Combined DNA/RNA Molecule: Synthetic oligonucleotide
cuugcggacgccgucuucctt

SEQ ID NO: 1800 - DNA, 21 bp, Artificial Sequence
  Description of Artificial Sequence: Synthetic oligonucleotide
  Description of Combined DNA/RNA Molecule: Synthetic oligonucleotide
gaagacggcguccgcaagutt

SEQ ID NO: 1801 - DNA, 21 bp, Artificial Sequence
  Description of Artificial Sequence: Synthetic oligonucleotide
  Description of Combined DNA/RNA Molecule: Synthetic oligonucleotide
acuugcggacgccgucuuctt

SEQ ID NO: 1802 - DNA, 21 bp, Artificial Sequence
  Description of Artificial Sequence: Synthetic oligonucleotide
  Description of Combined DNA/RNA Molecule: Synthetic oligonucleotide
aagacggcguccgcaagugtt

SEQ ID NO: 1803 - DNA, 21 bp, Artificial Sequence
  Description of Artificial Sequence: Synthetic oligonucleotide
  Description of Combined DNA/RNA Molecule: Synthetic oligonucleotide
cacuugcggacgccgucuutt

SEQ ID NO: 1804 - DNA, 21 bp, Artificial Sequence
  Description of Artificial Sequence: Synthetic oligonucleotide
  Description of Combined DNA/RNA Molecule: Synthetic oligonucleotide
gacggcguccgcaaguguatt

SEQ ID NO: 1805 - DNA, 21 bp, Artificial Sequence
  Description of Artificial Sequence: Synthetic oligonucleotide
  Description of Combined DNA/RNA Molecule: Synthetic oligonucleotide
uacacuugcggacgccguctt

SEQ ID NO: 1806 - DNA, 21 bp, Artificial Sequence
  Description of Artificial Sequence: Synthetic oligonucleotide
  Description of Combined DNA/RNA Molecule: Synthetic oligonucleotide
acggcguccgcaaguguaatt

SEQ ID NO: 1807 - DNA, 21 bp, Artificial Sequence
  Description of Artificial Sequence: Synthetic oligonucleotide
  Description of Combined DNA/RNA Molecule: Synthetic oligonucleotide
uuacacuugcggacgccgutt

SEQ ID NO: 1808 - DNA, 21 bp, Artificial Sequence
  Description of Artificial Sequence: Synthetic oligonucleotide
  Description of Combined DNA/RNA Molecule: Synthetic oligonucleotide
gcguccgcaaguguaagaatt

SEQ ID NO: 1809 - DNA, 21 bp, Artificial Sequence
  Description of Artificial Sequence: Synthetic oligonucleotide
  Description of Combined DNA/RNA Molecule: Synthetic oligonucleotide
uucuuacacuugcggacgctt

SEQ ID NO: 1810 - DNA, 21 bp, Artificial Sequence
  Description of Artificial Sequence: Synthetic oligonucleotide
  Description of Combined DNA/RNA Molecule: Synthetic oligonucleotide
cguccgcaaguguaagaagtt

SEQ ID NO: 1811 - DNA, 21 bp, Artificial Sequence
  Description of Artificial Sequence: Synthetic oligonucleotide
  Description of Combined DNA/RNA Molecule: Synthetic oligonucleotide
cuucuuacacuugcggacgtt

SEQ ID NO: 1812 - DNA, 21 bp, Artificial Sequence
  Description of Artificial Sequence: Synthetic oligonucleotide
  Description of Combined DNA/RNA Molecule: Synthetic oligonucleotide
guccgcaaguguaagaagutt

SEQ ID NO: 1813 - DNA, 21 bp, Artificial Sequence
  Description of Artificial Sequence: Synthetic oligonucleotide
  Description of Combined DNA/RNA Molecule: Synthetic oligonucleotide
acuucuuacacuugcggactt

SEQ ID NO: 1814 - DNA, 21 bp, Artificial Sequence
  Description of Artificial Sequence: Synthetic oligonucleotide
  Description of Combined DNA/RNA Molecule: Synthetic oligonucleotide
uccgcaaguguaagaagugtt

SEQ ID NO: 1815 - DNA, 21 bp, Artificial Sequence
  Description of Artificial Sequence: Synthetic oligonucleotide
  Description of Combined DNA/RNA Molecule: Synthetic oligonucleotide
cacuucuuacacuugcggatt

SEQ ID NO: 1816 - DNA, 21 bp, Artificial Sequence
  Description of Artificial Sequence: Synthetic oligonucleotide
  Description of Combined DNA/RNA Molecule: Synthetic oligonucleotide
ccgcaaguguaagaagugctt

SEQ ID NO: 1817 - DNA, 21 bp, Artificial Sequence
  Description of Artificial Sequence: Synthetic oligonucleotide
  Description of Combined DNA/RNA Molecule: Synthetic oligonucleotide
gcacuucuuacacuugcggtt

SEQ ID NO: 1818 - DNA, 21 bp, Artificial Sequence
  Description of Artificial Sequence: Synthetic oligonucleotide
  Description of Combined DNA/RNA Molecule: Synthetic oligonucleotide
cgcaaguguaagaagugcgtt

SEQ ID NO: 1819 - DNA, 21 bp, Artificial Sequence
  Description of Artificial Sequence: Synthetic oligonucleotide
  Description of Combined DNA/RNA Molecule: Synthetic oligonucleotide
cgcacuucuuacacuugcgtt

SEQ ID NO: 1820 - DNA, 21 bp, Artificial Sequence
  Description of Artificial Sequence: Synthetic oligonucleotide
  Description of Combined DNA/RNA Molecule: Synthetic oligonucleotide
gcaaguguaagaagugcgatt

SEQ ID NO: 1821 - DNA, 21 bp, Artificial Sequence
  Description of Artificial Sequence: Synthetic oligonucleotide
  Description of Combined DNA/RNA Molecule: Synthetic oligonucleotide
ucgcacuucuuacacuugctt

SEQ ID NO: 1822 - DNA, 21 bp, Artificial Sequence
  Description of Artificial Sequence: Synthetic oligonucleotide
  Description of Combined DNA/RNA Molecule: Synthetic oligonucleotide
aaguguaagaagugcgaagtt

SEQ ID NO: 1823 - DNA, 21 bp, Artificial Sequence
  Description of Artificial Sequence: Synthetic oligonucleotide
  Description of Combined DNA/RNA Molecule: Synthetic oligonucleotide
cuucgcacuucuuacacuutt

SEQ ID NO: 1824 - DNA, 21 bp, Artificial Sequence
  Description of Artificial Sequence: Synthetic oligonucleotide
  Description of Combined DNA/RNA Molecule: Synthetic oligonucleotide
aguguaagaagugcgaaggtt

SEQ ID NO: 1825 - DNA, 21 bp, Artificial Sequence
  Description of Artificial Sequence: Synthetic oligonucleotide
  Description of Combined DNA/RNA Molecule: Synthetic oligonucleotide
ccuucgcacuucuuacacutt

SEQ ID NO: 1826 - DNA, 21 bp, Artificial Sequence
  Description of Artificial Sequence: Synthetic oligonucleotide
  Description of Combined DNA/RNA Molecule: Synthetic oligonucleotide
guguaagaagugcgaagggtt

SEQ ID NO: 1827 - DNA, 21 bp, Artificial Sequence
  Description of Artificial Sequence: Synthetic oligonucleotide
  Description of Combined DNA/RNA Molecule: Synthetic oligonucleotide
cccuucgcacuucuuacactt

SEQ ID NO: 1828 - DNA, 21 bp, Artificial Sequence
  Description of Artificial Sequence: Synthetic oligonucleotide
  Description of Combined DNA/RNA Molecule: Synthetic oligonucleotide
uguaagaagugcgaagggctt

SEQ ID NO: 1829 - DNA, 21 bp, Artificial Sequence
  Description of Artificial Sequence: Synthetic oligonucleotide
  Description of Combined DNA/RNA Molecule: Synthetic oligonucleotide
gcccuucgcacuucuuacatt

SEQ ID NO: 1830 - DNA, 21 bp, Artificial Sequence
  Description of Artificial Sequence: Synthetic oligonucleotide
  Description of Combined DNA/RNA Molecule: Synthetic oligonucleotide
guaagaagugcgaagggcctt

SEQ ID NO: 1831 - DNA, 21 bp, Artificial Sequence
  Description of Artificial Sequence: Synthetic oligonucleotide
  Description of Combined DNA/RNA Molecule: Synthetic oligonucleotide
ggcccuucgcacuucuuactt

SEQ ID NO: 1832 - DNA, 21 bp, Artificial Sequence
  Description of Artificial Sequence: Synthetic oligonucleotide
  Description of Combined DNA/RNA Molecule: Synthetic oligonucleotide
uaagaagugcgaagggccutt

SEQ ID NO: 1833 - DNA, 21 bp, Artificial Sequence
  Description of Artificial Sequence: Synthetic oligonucleotide
  Description of Combined DNA/RNA Molecule: Synthetic oligonucleotide
aggcccuucgcacuucuuatt

SEQ ID NO: 1834 - DNA, 21 bp, Artificial Sequence
  Description of Artificial Sequence: Synthetic oligonucleotide
  Description of Combined DNA/RNA Molecule: Synthetic oligonucleotide
aagaagugcgaagggccuutt

SEQ ID NO: 1835 - DNA, 21 bp, Artificial Sequence
  Description of Artificial Sequence: Synthetic oligonucleotide
  Description of Combined DNA/RNA Molecule: Synthetic oligonucleotide
aaggcccuucgcacuucuutt

SEQ ID NO: 1836 - DNA, 21 bp, Artificial Sequence
  Description of Artificial Sequence: Synthetic oligonucleotide
  Description of Combined DNA/RNA Molecule: Synthetic oligonucleotide
agaagugcgaagggccuugtt

SEQ ID NO: 1837 - DNA, 21 bp, Artificial Sequence
  Description of Artificial Sequence: Synthetic oligonucleotide
  Description of Combined DNA/RNA Molecule: Synthetic oligonucleotide
caaggcccuucgcacuucutt

SEQ ID NO: 1838 - DNA, 21 bp, Artificial Sequence
  Description of Artificial Sequence: Synthetic oligonucleotide
  Description of Combined DNA/RNA Molecule: Synthetic oligonucleotide
agugcgaagggccuugccgtt

SEQ ID NO: 1839 - DNA, 21 bp, Artificial Sequence
  Description of Artificial Sequence: Synthetic oligonucleotide
  Description of Combined DNA/RNA Molecule: Synthetic oligonucleotide
cggcaaggcccuucgcacutt

SEQ ID NO: 1840 - DNA, 21 bp, Artificial Sequence
  Description of Artificial Sequence: Synthetic oligonucleotide
  Description of Combined DNA/RNA Molecule: Synthetic oligonucleotide
gugcgaagggccuugccgctt

SEQ ID NO: 1841 - DNA, 21 bp, Artificial Sequence
  Description of Artificial Sequence: Synthetic oligonucleotide
  Description of Combined DNA/RNA Molecule: Synthetic oligonucleotide
gcggcaaggcccuucgcactt

SEQ ID NO: 1842 - DNA, 21 bp, Artificial Sequence
  Description of Artificial Sequence: Synthetic oligonucleotide
  Description of Combined DNA/RNA Molecule: Synthetic oligonucleotide
ugcgaagggccuugccgcatt

SEQ ID NO: 1843 - DNA, 21 bp, Artificial Sequence
  Description of Artificial Sequence: Synthetic oligonucleotide
  Description of Combined DNA/RNA Molecule: Synthetic oligonucleotide
ugcggcaaggcccuucgcatt

SEQ ID NO: 1844 - DNA, 21 bp, Artificial Sequence
  Description of Artificial Sequence: Synthetic oligonucleotide
  Description of Combined DNA/RNA Molecule: Synthetic oligonucleotide
gcgaagggccuugccgcaatt

SEQ ID NO: 1845 - DNA, 21 bp, Artificial Sequence
  Description of Artificial Sequence: Synthetic oligonucleotide
  Description of Combined DNA/RNA Molecule: Synthetic oligonucleotide
uugcggcaaggcccuucgctt

SEQ ID NO: 1846 - DNA, 21 bp, Artificial Sequence
  Description of Artificial Sequence: Synthetic oligonucleotide
  Description of Combined DNA/RNA Molecule: Synthetic oligonucleotide
cgaagggccuugccgcaaatt

SEQ ID NO: 1847 - DNA, 21 bp, Artificial Sequence
  Description of Artificial Sequence: Synthetic oligonucleotide
  Description of Combined DNA/RNA Molecule: Synthetic oligonucleotide
uuugcggcaaggcccuucgtt

SEQ ID NO: 1848 - DNA, 21 bp, Artificial Sequence
  Description of Artificial Sequence: Synthetic oligonucleotide
  Description of Combined DNA/RNA Molecule: Synthetic oligonucleotide
aagggccuugccgcaaagutt

SEQ ID NO: 1849 - DNA, 21 bp, Artificial Sequence
  Description of Artificial Sequence: Synthetic oligonucleotide
  Description of Combined DNA/RNA Molecule: Synthetic oligonucleotide
acuuugcggcaaggcccuutt

SEQ ID NO: 1850 - DNA, 21 bp, Artificial Sequence
  Description of Artificial Sequence: Synthetic oligonucleotide
  Description of Combined DNA/RNA Molecule: Synthetic oligonucleotide
agggccuugccgcaaagugtt

SEQ ID NO: 1851 - DNA, 21 bp, Artificial Sequence
  Description of Artificial Sequence: Synthetic oligonucleotide
  Description of Combined DNA/RNA Molecule: Synthetic oligonucleotide
cacuuugcggcaaggcccutt

SEQ ID NO: 1852 - DNA, 21 bp, Artificial Sequence
  Description of Artificial Sequence: Synthetic oligonucleotide
  Description of Combined DNA/RNA Molecule: Synthetic oligonucleotide
gggccuugccgcaaagugutt

SEQ ID NO: 1853 - DNA, 21 bp, Artificial Sequence
  Description of Artificial Sequence: Synthetic oligonucleotide
  Description of Combined DNA/RNA Molecule: Synthetic oligonucleotide
acacuuugcggcaaggccctt

SEQ ID NO: 1854 - DNA, 21 bp, Artificial Sequence
  Description of Artificial Sequence: Synthetic oligonucleotide
  Description of Combined DNA/RNA Molecule: Synthetic oligonucleotide
ggccuugccgcaaagugugtt

SEQ ID NO: 1855 - DNA, 21 bp, Artificial Sequence
  Description of Artificial Sequence: Synthetic oligonucleotide
  Description of Combined DNA/RNA Molecule: Synthetic oligonucleotide
cacacuuugcggcaaggcctt

SEQ ID NO: 1856 - DNA, 21 bp, Artificial Sequence
  Description of Artificial Sequence: Synthetic oligonucleotide
  Description of Combined DNA/RNA Molecule: Synthetic oligonucleotide
gccuugccgcaaagugugutt

SEQ ID NO: 1857 - DNA, 21 bp, Artificial Sequence
  Description of Artificial Sequence: Synthetic oligonucleotide
  Description of Combined DNA/RNA Molecule: Synthetic oligonucleotide
acacacuuugcggcaaggctt

SEQ ID NO: 1858 - DNA, 21 bp, Artificial Sequence
  Description of Artificial Sequence: Synthetic oligonucleotide
  Description of Combined DNA/RNA Molecule: Synthetic oligonucleotide
cuugccgcaaaguguguaatt

SEQ ID NO: 1859 - DNA, 21 bp, Artificial Sequence
  Description of Artificial Sequence: Synthetic oligonucleotide
  Description of Combined DNA/RNA Molecule: Synthetic oligonucleotide
uuacacacuuugcggcaagtt

SEQ ID NO: 1860 - DNA, 21 bp, Artificial Sequence
  Description of Artificial Sequence: Synthetic oligonucleotide
  Description of Combined DNA/RNA Molecule: Synthetic oligonucleotide
ggaauagguauuggugaautt

SEQ ID NO: 1861 - DNA, 21 bp, Artificial Sequence
  Description of Artificial Sequence: Synthetic oligonucleotide
  Description of Combined DNA/RNA Molecule: Synthetic oligonucleotide
auucaccaauaccuauucctt

SEQ ID NO: 1862 - DNA, 21 bp, Artificial Sequence
  Description of Artificial Sequence: Synthetic oligonucleotide
  Description of Combined DNA/RNA Molecule: Synthetic oligonucleotide
gaauagguauuggugaauutt

SEQ ID NO: 1863 - DNA, 21 bp, Artificial Sequence
  Description of Artificial Sequence: Synthetic oligonucleotide
  Description of Combined DNA/RNA Molecule: Synthetic oligonucleotide
aauucaccaauaccuauuctt

SEQ ID NO: 1864 - DNA, 21 bp, Artificial Sequence
  Description of Artificial Sequence: Synthetic oligonucleotide
  Description of Combined DNA/RNA Molecule: Synthetic oligonucleotide
aauagguauuggugaauuutt

SEQ ID NO: 1865 - DNA, 21 bp, Artificial Sequence
  Description of Artificial Sequence: Synthetic oligonucleotide
  Description of Combined DNA/RNA Molecule: Synthetic oligonucleotide
aaauucaccaauaccuauutt

SEQ ID NO: 1866 - DNA, 21 bp, Artificial Sequence
  Description of Artificial Sequence: Synthetic oligonucleotide
  Description of Combined DNA/RNA Molecule: Synthetic oligonucleotide
auagguauuggugaauuuatt

SEQ ID NO: 1867 - DNA, 21 bp, Artificial Sequence
  Description of Artificial Sequence: Synthetic oligonucleotide
  Description of Combined DNA/RNA Molecule: Synthetic oligonucleotide
uaaauucaccaauaccuautt

SEQ ID NO: 1868 - DNA, 21 bp, Artificial Sequence
  Description of Artificial Sequence: Synthetic oligonucleotide
  Description of Combined DNA/RNA Molecule: Synthetic oligonucleotide
agguauuggugaauuuaaatt

SEQ ID NO: 1869 - DNA, 21 bp, Artificial Sequence
  Description of Artificial Sequence: Synthetic oligonucleotide
  Description of Combined DNA/RNA Molecule: Synthetic oligonucleotide
uuuaaauucaccaauaccutt

SEQ ID NO: 1870 - DNA, 21 bp, Artificial Sequence
  Description of Artificial Sequence: Synthetic oligonucleotide
  Description of Combined DNA/RNA Molecule: Synthetic oligonucleotide
gguauuggugaauuuaaagtt

SEQ ID NO: 1871 - DNA, 21 bp, Artificial Sequence
  Description of Artificial Sequence: Synthetic oligonucleotide
  Description of Combined DNA/RNA Molecule: Synthetic oligonucleotide
cuuuaaauucaccaauacctt

SEQ ID NO: 1872 - DNA, 21 bp, Artificial Sequence
  Description of Artificial Sequence: Synthetic oligonucleotide
  Description of Combined DNA/RNA Molecule: Synthetic oligonucleotide
cacucuccauaaaugcuactt

SEQ ID NO: 1873 - DNA, 21 bp, Artificial Sequence
  Description of Artificial Sequence: Synthetic oligonucleotide
  Description of Combined DNA/RNA Molecule: Synthetic oligonucleotide
guagcauuuauggagagugtt

SEQ ID NO: 1874 - DNA, 21 bp, Artificial Sequence
  Description of Artificial Sequence: Synthetic oligonucleotide
  Description of Combined DNA/RNA Molecule: Synthetic oligonucleotide
uuaaacacuucaaaaacugtt

SEQ ID NO: 1875 - DNA, 21 bp, Artificial Sequence
  Description of Artificial Sequence: Synthetic oligonucleotide
  Description of Combined DNA/RNA Molecule: Synthetic oligonucleotide
caguuuuugaaguguuuaatt

SEQ ID NO: 1876 - DNA, 21 bp, Artificial Sequence
  Description of Artificial Sequence: Synthetic oligonucleotide
  Description of Combined DNA/RNA Molecule: Synthetic oligonucleotide
cuucaaaaacugcaccucctt

SEQ ID NO: 1877 - DNA, 21 bp, Artificial Sequence
  Description of Artificial Sequence: Synthetic oligonucleotide
  Description of Combined DNA/RNA Molecule: Synthetic oligonucleotide
ggaggugcaguuuuugaagtt

SEQ ID NO: 1878 - DNA, 21 bp, Artificial Sequence
  Description of Artificial Sequence: Synthetic oligonucleotide
  Description of Combined DNA/RNA Molecule: Synthetic oligonucleotide
uucaaaaacugcaccuccatt

SEQ ID NO: 1879 - DNA, 21 bp, Artificial Sequence
  Description of Artificial Sequence: Synthetic oligonucleotide
  Description of Combined DNA/RNA Molecule: Synthetic oligonucleotide
uggaggugcaguuuuugaatt

SEQ ID NO: 1880 - DNA, 21 bp, Artificial Sequence
  Description of Artificial Sequence: Synthetic oligonucleotide
  Description of Combined DNA/RNA Molecule: Synthetic oligonucleotide
ucaaaaacugcaccuccautt

SEQ ID NO: 1881 - DNA, 21 bp, Artificial Sequence
  Description of Artificial Sequence: Synthetic oligonucleotide
  Description of Combined DNA/RNA Molecule: Synthetic oligonucleotide
auggaggugcaguuuuugatt

SEQ ID NO: 1882 - DNA, 21 bp, Artificial Sequence
  Description of Artificial Sequence: Synthetic oligonucleotide
  Description of Combined DNA/RNA Molecule: Synthetic oligonucleotide
caaaaacugcaccuccauctt

SEQ ID NO: 1883 - DNA, 21 bp, Artificial Sequence
  Description of Artificial Sequence: Synthetic oligonucleotide
  Description of Combined DNA/RNA Molecule: Synthetic oligonucleotide
gauggaggugcaguuuuugtt

SEQ ID NO: 1884 - DNA, 21 bp, Artificial Sequence
  Description of Artificial Sequence: Synthetic oligonucleotide
  Description of Combined DNA/RNA Molecule: Synthetic oligonucleotide
aaaaacugcaccuccaucatt

SEQ ID NO: 1885 - DNA, 21 bp, Artificial Sequence
  Description of Artificial Sequence: Synthetic oligonucleotide
  Description of Combined DNA/RNA Molecule: Synthetic oligonucleotide
ugauggaggugcaguuuuutt

SEQ ID NO: 1886 - DNA, 21 bp, Artificial Sequence
  Description of Artificial Sequence: Synthetic oligonucleotide
  Description of Combined DNA/RNA Molecule: Synthetic oligonucleotide
acugcaccuccaucaguggtt

SEQ ID NO: 1887 - DNA, 21 bp, Artificial Sequence
  Description of Artificial Sequence: Synthetic oligonucleotide
  Description of Combined DNA/RNA Molecule: Synthetic oligonucleotide
ccacugauggaggugcagutt

SEQ ID NO: 1888 - DNA, 21 bp, Artificial Sequence
  Description of Artificial Sequence: Synthetic oligonucleotide
  Description of Combined DNA/RNA Molecule: Synthetic oligonucleotide
caccuccaucaguggcgautt

SEQ ID NO: 1889 - DNA, 21 bp, Artificial Sequence
  Description of Artificial Sequence: Synthetic oligonucleotide
  Description of Combined DNA/RNA Molecule: Synthetic oligonucleotide
aucgccacugauggaggugtt

SEQ ID NO: 1890 - DNA, 21 bp, Artificial Sequence
  Description of Artificial Sequence: Synthetic oligonucleotide
  Description of Combined DNA/RNA Molecule: Synthetic oligonucleotide
accuccaucaguggcgauctt

SEQ ID NO: 1891 - DNA, 21 bp, Artificial Sequence
  Description of Artificial Sequence: Synthetic oligonucleotide
  Description of Combined DNA/RNA Molecule: Synthetic oligonucleotide
gaucgccacugauggaggutt

SEQ ID NO: 1892 - DNA, 21 bp, Artificial Sequence
  Description of Artificial Sequence: Synthetic oligonucleotide
  Description of Combined DNA/RNA Molecule: Synthetic oligonucleotide
cuccaucaguggcgaucuctt

SEQ ID NO: 1893 - DNA, 21 bp, Artificial Sequence
  Description of Artificial Sequence: Synthetic oligonucleotide
  Description of Combined DNA/RNA Molecule: Synthetic oligonucleotide
gagaucgccacugauggagtt

SEQ ID NO: 1894 - DNA, 21 bp, Artificial Sequence
  Description of Artificial Sequence: Synthetic oligonucleotide
  Description of Combined DNA/RNA Molecule: Synthetic oligonucleotide
caucaguggcgaucuccactt

SEQ ID NO: 1895 - DNA, 21 bp, Artificial Sequence
  Description of Artificial Sequence: Synthetic oligonucleotide
  Description of Combined DNA/RNA Molecule: Synthetic oligonucleotide
guggagaucgccacugaugtt

SEQ ID NO: 1896 - DNA, 21 bp, Artificial Sequence
  Description of Artificial Sequence: Synthetic oligonucleotide
  Description of Combined DNA/RNA Molecule: Synthetic oligonucleotide
uggcgaucuccacauccugtt

SEQ ID NO: 1897 - DNA, 21 bp, Artificial Sequence
  Description of Artificial Sequence: Synthetic oligonucleotide
  Description of Combined DNA/RNA Molecule: Synthetic oligonucleotide
caggauguggagaucgccatt

SEQ ID NO: 1898 - DNA, 21 bp, Artificial Sequence
  Description of Artificial Sequence: Synthetic oligonucleotide
  Description of Combined DNA/RNA Molecule: Synthetic oligonucleotide
ggcgaucuccacauccugctt

SEQ ID NO: 1899 - DNA, 21 bp, Artificial Sequence
  Description of Artificial Sequence: Synthetic oligonucleotide
  Description of Combined DNA/RNA Molecule: Synthetic oligonucleotide
gcaggauguggagaucgcctt

SEQ ID NO: 1900 - DNA, 21 bp, Artificial Sequence
  Description of Artificial Sequence: Synthetic oligonucleotide
  Description of Combined DNA/RNA Molecule: Synthetic oligonucleotide
gcgaucuccacauccugcctt

SEQ ID NO: 1901 - DNA, 21 bp, Artificial Sequence
  Description of Artificial Sequence: Synthetic oligonucleotide
  Description of Combined DNA/RNA Molecule: Synthetic oligonucleotide
ggcaggauguggagaucgctt

SEQ ID NO: 1902 - DNA, 21 bp, Artificial Sequence
  Description of Artificial Sequence: Synthetic oligonucleotide
  Description of Combined DNA/RNA Molecule: Synthetic oligonucleotide
cgaucuccacauccugccgtt

SEQ ID NO: 1903 - DNA, 21 bp, Artificial Sequence
  Description of Artificial Sequence: Synthetic oligonucleotide
  Description of Combined DNA/RNA Molecule: Synthetic oligonucleotide
cggcaggauguggagaucgtt

SEQ ID NO: 1904 - DNA, 21 bp, Artificial Sequence
  Description of Artificial Sequence: Synthetic oligonucleotide
  Description of Combined DNA/RNA Molecule: Synthetic oligonucleotide
gaucuccacauccugccggtt

SEQ ID NO: 1905 - DNA, 21 bp, Artificial Sequence
  Description of Artificial Sequence: Synthetic oligonucleotide
  Description of Combined DNA/RNA Molecule: Synthetic oligonucleotide
ccggcaggauguggagauctt

SEQ ID NO: 1906 - DNA, 21 bp, Artificial Sequence
  Description of Artificial Sequence: Synthetic oligonucleotide
  Description of Combined DNA/RNA Molecule: Synthetic oligonucleotide
ccacauccugccgguggcatt

SEQ ID NO: 1907 - DNA, 21 bp, Artificial Sequence
  Description of Artificial Sequence: Synthetic oligonucleotide
  Description of Combined DNA/RNA Molecule: Synthetic oligonucleotide
ugccaccggcaggauguggtt

SEQ ID NO: 1908 - DNA, 21 bp, Artificial Sequence
  Description of Artificial Sequence: Synthetic oligonucleotide
  Description of Combined DNA/RNA Molecule: Synthetic oligonucleotide
cacauccugccgguggcautt

SEQ ID NO: 1909 - DNA, 21 bp, Artificial Sequence
  Description of Artificial Sequence: Synthetic oligonucleotide
  Description of Combined DNA/RNA Molecule: Synthetic oligonucleotide
augccaccggcaggaugugtt

SEQ ID NO: 1910 - DNA, 21 bp, Artificial Sequence
  Description of Artificial Sequence: Synthetic oligonucleotide
  Description of Combined DNA/RNA Molecule: Synthetic oligonucleotide
acauccugccgguggcauutt

SEQ ID NO: 1911 - DNA, 21 bp, Artificial Sequence
  Description of Artificial Sequence: Synthetic oligonucleotide
  Description of Combined DNA/RNA Molecule: Synthetic oligonucleotide
aaugccaccggcaggaugutt

SEQ ID NO: 1912 - DNA, 21 bp, Artificial Sequence
  Description of Artificial Sequence: Synthetic oligonucleotide
  Description of Combined DNA/RNA Molecule: Synthetic oligonucleotide
auccugccgguggcauuuatt

SEQ ID NO: 1913 - DNA, 21 bp, Artificial Sequence
  Description of Artificial Sequence: Synthetic oligonucleotide
  Description of Combined DNA/RNA Molecule: Synthetic oligonucleotide
uaaaugccaccggcaggautt

SEQ ID NO: 1914 - DNA, 21 bp, Artificial Sequence
  Description of Artificial Sequence: Synthetic oligonucleotide
  Description of Combined DNA/RNA Molecule: Synthetic oligonucleotide
cugccgguggcauuuagggtt

SEQ ID NO: 1915 - DNA, 21 bp, Artificial Sequence
  Description of Artificial Sequence: Synthetic oligonucleotide
  Description of Combined DNA/RNA Molecule: Synthetic oligonucleotide
cccuaaaugccaccggcagtt

SEQ ID NO: 1916 - DNA, 21 bp, Artificial Sequence
  Description of Artificial Sequence: Synthetic oligonucleotide
  Description of Combined DNA/RNA Molecule: Synthetic oligonucleotide
ugccgguggcauuuaggggtt

SEQ ID NO: 1917 - DNA, 21 bp, Artificial Sequence
  Description of Artificial Sequence: Synthetic oligonucleotide
  Description of Combined DNA/RNA Molecule: Synthetic oligonucleotide
ccccuaaaugccaccggcatt

SEQ ID NO: 1918 - DNA, 21 bp, Artificial Sequence
  Description of Artificial Sequence: Synthetic oligonucleotide
  Description of Combined DNA/RNA Molecule: Synthetic oligonucleotide
gccgguggcauuuaggggutt

SEQ ID NO: 1919 - DNA, 21 bp, Artificial Sequence
  Description of Artificial Sequence: Synthetic oligonucleotide
  Description of Combined DNA/RNA Molecule: Synthetic oligonucleotide
accccuaaaugccaccggctt

SEQ ID NO: 1920 - DNA, 21 bp, Artificial Sequence
  Description of Artificial Sequence: Synthetic oligonucleotide
  Description of Combined DNA/RNA Molecule: Synthetic oligonucleotide
ccgguggcauuuaggggugtt

SEQ ID NO: 1921 - DNA, 21 bp, Artificial Sequence
  Description of Artificial Sequence: Synthetic oligonucleotide
  Description of Combined DNA/RNA Molecule: Synthetic oligonucleotide
caccccuaaaugccaccggtt

SEQ ID NO: 1922 - DNA, 21 bp, Artificial Sequence
  Description of Artificial Sequence: Synthetic oligonucleotide
  Description of Combined DNA/RNA Molecule: Synthetic oligonucleotide
guggcauuuaggggugacutt

SEQ ID NO: 1923 - DNA, 21 bp, Artificial Sequence
  Description of Artificial Sequence: Synthetic oligonucleotide
  Description of Combined DNA/RNA Molecule: Synthetic oligonucleotide
agucaccccuaaaugccactt

SEQ ID NO: 1924 - DNA, 21 bp, Artificial Sequence
  Description of Artificial Sequence: Synthetic oligonucleotide
  Description of Combined DNA/RNA Molecule: Synthetic oligonucleotide
gcauuuaggggugacuccutt

SEQ ID NO: 1925 - DNA, 21 bp, Artificial Sequence
  Description of Artificial Sequence: Synthetic oligonucleotide
  Description of Combined DNA/RNA Molecule: Synthetic oligonucleotide
aggagucaccccuaaaugctt

SEQ ID NO: 1926 - DNA, 21 bp, Artificial Sequence
  Description of Artificial Sequence: Synthetic oligonucleotide
  Description of Combined DNA/RNA Molecule: Synthetic oligonucleotide
cauuuaggggugacuccuutt

SEQ ID NO: 1927 - DNA, 21 bp, Artificial Sequence
  Description of Artificial Sequence: Synthetic oligonucleotide
  Description of Combined DNA/RNA Molecule: Synthetic oligonucleotide
aaggagucaccccuaaaugtt

SEQ ID NO: 1928 - DNA, 21 bp, Artificial Sequence
  Description of Artificial Sequence: Synthetic oligonucleotide
  Description of Combined DNA/RNA Molecule: Synthetic oligonucleotide
auuuaggggugacuccuuctt

SEQ ID NO: 1929 - DNA, 21 bp, Artificial Sequence
  Description of Artificial Sequence: Synthetic oligonucleotide
  Description of Combined DNA/RNA Molecule: Synthetic oligonucleotide
gaaggagucaccccuaaautt

SEQ ID NO: 1930 - DNA, 21 bp, Artificial Sequence
  Description of Artificial Sequence: Synthetic oligonucleotide
  Description of Combined DNA/RNA Molecule: Synthetic oligonucleotide
uuuaggggugacuccuucatt

SEQ ID NO: 1931 - DNA, 21 bp, Artificial Sequence
  Description of Artificial Sequence: Synthetic oligonucleotide
  Description of Combined DNA/RNA Molecule: Synthetic oligonucleotide
ugaaggagucaccccuaaatt

SEQ ID NO: 1932 - DNA, 21 bp, Artificial Sequence
  Description of Artificial Sequence: Synthetic oligonucleotide
  Description of Combined DNA/RNA Molecule: Synthetic oligonucleotide
uuaggggugacuccuucactt

SEQ ID NO: 1933 - DNA, 21 bp, Artificial Sequence
  Description of Artificial Sequence: Synthetic oligonucleotide
  Description of Combined DNA/RNA Molecule: Synthetic oligonucleotide
gugaaggagucaccccuaatt

SEQ ID NO: 1934 - DNA, 21 bp, Artificial Sequence
  Description of Artificial Sequence: Synthetic oligonucleotide
  Description of Combined DNA/RNA Molecule: Synthetic oligonucleotide
uaggggugacuccuucacatt

SEQ ID NO: 1935 - DNA, 21 bp, Artificial Sequence
  Description of Artificial Sequence: Synthetic oligonucleotide
  Description of Combined DNA/RNA Molecule: Synthetic oligonucleotide
ugugaaggagucaccccuatt

SEQ ID NO: 1936 - DNA, 21 bp, Artificial Sequence
  Description of Artificial Sequence: Synthetic oligonucleotide
  Description of Combined DNA/RNA Molecule: Synthetic oligonucleotide
ucuggauccacaggaacugtt

SEQ ID NO: 1937 - DNA, 21 bp, Artificial Sequence
  Description of Artificial Sequence: Synthetic oligonucleotide
  Description of Combined DNA/RNA Molecule: Synthetic oligonucleotide
caguuccuguggauccagatt

SEQ ID NO: 1938 - DNA, 21 bp, Artificial Sequence
  Description of Artificial Sequence: Synthetic oligonucleotide
  Description of Combined DNA/RNA Molecule: Synthetic oligonucleotide
gauccacaggaacuggauatt

SEQ ID NO: 1939 - DNA, 21 bp, Artificial Sequence
  Description of Artificial Sequence: Synthetic oligonucleotide
  Description of Combined DNA/RNA Molecule: Synthetic oligonucleotide
uauccaguuccuguggauctt

SEQ ID NO: 1940 - DNA, 21 bp, Artificial Sequence
  Description of Artificial Sequence: Synthetic oligonucleotide
  Description of Combined DNA/RNA Molecule: Synthetic oligonucleotide
auccacaggaacuggauautt

SEQ ID NO: 1941 - DNA, 21 bp, Artificial Sequence
  Description of Artificial Sequence: Synthetic oligonucleotide
  Description of Combined DNA/RNA Molecule: Synthetic oligonucleotide
auauccaguuccuguggautt

SEQ ID NO: 1942 - DNA, 21 bp, Artificial Sequence
  Description of Artificial Sequence: Synthetic oligonucleotide
  Description of Combined DNA/RNA Molecule: Synthetic oligonucleotide
ccacaggaacuggauauuctt

SEQ ID NO: 1943 - DNA, 21 bp, Artificial Sequence
  Description of Artificial Sequence: Synthetic oligonucleotide
  Description of Combined DNA/RNA Molecule: Synthetic oligonucleotide
gaauauccaguuccuguggtt

SEQ ID NO: 1944 - DNA, 21 bp, Artificial Sequence
  Description of Artificial Sequence: Synthetic oligonucleotide
  Description of Combined DNA/RNA Molecule: Synthetic oligonucleotide
cacaggaacuggauauucutt

SEQ ID NO: 1945 - DNA, 21 bp, Artificial Sequence
  Description of Artificial Sequence: Synthetic oligonucleotide
  Description of Combined DNA/RNA Molecule: Synthetic oligonucleotide
agaauauccaguuccugugtt

SEQ ID NO: 1946 - DNA, 21 bp, Artificial Sequence
  Description of Artificial Sequence: Synthetic oligonucleotide
  Description of Combined DNA/RNA Molecule: Synthetic oligonucleotide
acuggauauucugaaaacctt

SEQ ID NO: 1947 - DNA, 21 bp, Artificial Sequence
  Description of Artificial Sequence: Synthetic oligonucleotide
  Description of Combined DNA/RNA Molecule: Synthetic oligonucleotide
gguuuucagaauauccagutt

SEQ ID NO: 1948 - DNA, 21 bp, Artificial Sequence
  Description of Artificial Sequence: Synthetic oligonucleotide
  Description of Combined DNA/RNA Molecule: Synthetic oligonucleotide
auucugaaaaccguaaaggtt

SEQ ID NO: 1949 - DNA, 21 bp, Artificial Sequence
  Description of Artificial Sequence: Synthetic oligonucleotide
  Description of Combined DNA/RNA Molecule: Synthetic oligonucleotide
ccuuuacgguuuucagaautt

SEQ ID NO: 1950 - DNA, 21 bp, Artificial Sequence
  Description of Artificial Sequence: Synthetic oligonucleotide
  Description of Combined DNA/RNA Molecule: Synthetic oligonucleotide
uucugaaaaccguaaaggatt

SEQ ID NO: 1951 - DNA, 21 bp, Artificial Sequence
  Description of Artificial Sequence: Synthetic oligonucleotide
  Description of Combined DNA/RNA Molecule: Synthetic oligonucleotide
uccuuuacgguuuucagaatt

SEQ ID NO: 1952 - DNA, 21 bp, Artificial Sequence
  Description of Artificial Sequence: Synthetic oligonucleotide
  Description of Combined DNA/RNA Molecule: Synthetic oligonucleotide
ugaaaaccguaaaggaaautt

SEQ ID NO: 1953 - DNA, 21 bp, Artificial Sequence
  Description of Artificial Sequence: Synthetic oligonucleotide
  Description of Combined DNA/RNA Molecule: Synthetic oligonucleotide
auuuccuuuacgguuuucatt

SEQ ID NO: 1954 - DNA, 21 bp, Artificial Sequence
  Description of Artificial Sequence: Synthetic oligonucleotide
  Description of Combined DNA/RNA Molecule: Synthetic oligonucleotide
gaaaaccguaaaggaaauctt

SEQ ID NO: 1955 - DNA, 21 bp, Artificial Sequence
  Description of Artificial Sequence: Synthetic oligonucleotide
  Description of Combined DNA/RNA Molecule: Synthetic oligonucleotide
gauuuccuuuacgguuuuctt

SEQ ID NO: 1956 - RNA, 23 nt, Homo sapiens
caaagguucucugcuagacgaca

SEQ ID NO: 1957 - RNA, 23 nt, Homo sapiens
ucugggugucacuauggagcucu

SEQ ID NO: 1958 - RNA, 23 nt, Homo sapiens
cugggugucacuauggagcucuc

SEQ ID NO: 1959 - RNA, 23 nt, Homo sapiens
gggugucacuauggagcucucac

SEQ ID NO: 1960 - RNA, 23 nt, Homo sapiens
uacuacaacuuuccacuggcucu

SEQ ID NO: 1961 - RNA, 23 nt, Homo sapiens
aagcuucugggugucacuaugga

SEQ ID NO: 1962 - RNA, 23 nt, Homo sapiens
cuucugggugucacuauggagcu

SEQ ID NO: 1963 - RNA, 21 nt, Homo sapiens
cuguuggauugauucgaaauu

SEQ ID NO: 1964 - RNA, 21 nt, Homo sapiens
uuucgaaucaauccaacaguu

SEQ ID NO: 1965 - RNA, 21 nt, Homo sapiens
acgacuaguucaguugcuuuu

SEQ ID NO: 1966 - RNA, 21 nt, Homo sapiens
aagcaacugaacuagucguuu

SEQ ID NO: 1967 - RNA, 23 nt, Artificial Sequence
  Description of Artificial Sequence: Synthetic oligonucleotide
  modified_base (1)..(1): Inverted abasic nucleotide
  modified_base (23)..(23): Inverted abasic nucleotide
ncuguuggauugauucgaaauun

SEQ ID NO: 1968 - RNA, 21 nt, Artificial Sequence
  Description of Artificial Sequence: Synthetic oligonucleotide
uuucgaaucaauccaacaguu

SEQ ID NO: 1969 - RNA, 23 nt, Artificial Sequence
  Description of Artificial Sequence: Synthetic oligonucleotide
  modified_base (1)..(1): Inverted abasic nucleotide
  modified_base (23)..(23): Inverted abasic nucleotide
nacgacuaguucaguugcuuuun

SEQ ID NO: 1970 - RNA, 21 nt, Artificial Sequence
  Description of Artificial Sequence: Synthetic oligonucleotide
aagcaacugaacuagucguuu

SEQ ID NO: 1971 - DNA, 21 bp, Artificial Sequence
  Description of Artificial Sequence: Synthetic oligonucleotide
  Description of Combined DNA/RNA Molecule: Synthetic oligonucleotide
gcucaaagcaauuucuacatt

SEQ ID NO: 1972 - DNA, 21 bp, Artificial Sequence
  Description of Artificial Sequence: Synthetic oligonucleotide
  Description of Combined DNA/RNA Molecule: Synthetic oligonucleotide
uguagaaauugcuuugagctt

SEQ ID NO: 1973 - DNA, 21 bp, Artificial Sequence
  Description of Artificial Sequence: Synthetic oligonucleotide
  Description of Combined DNA/RNA Molecule: Synthetic oligonucleotide
ggaugaaacacaaaagguatt

SEQ ID NO: 1974 - DNA, 21 bp, Artificial Sequence
  Description of Artificial Sequence: Synthetic oligonucleotide
  Description of Combined DNA/RNA Molecule: Synthetic oligonucleotide
uaccuuuuguguuucaucctt

SEQ ID NO: 1975 - DNA, 21 bp, Artificial Sequence
  Description of Artificial Sequence: Synthetic oligonucleotide
  Description of Combined DNA/RNA Molecule: Synthetic oligonucleotide
ugucagaguuacuguuucatt

SEQ ID NO: 1976 - DNA, 21 bp, Artificial Sequence
  Description of Artificial Sequence: Synthetic oligonucleotide
  Description of Combined DNA/RNA Molecule: Synthetic oligonucleotide
ugaaacaguaacucugacatt

SEQ ID NO: 1977 - DNA, 21 bp, Artificial Sequence
  Description of Artificial Sequence: Synthetic oligonucleotide
  Description of Combined DNA/RNA Molecule: Synthetic oligonucleotide
agcaagaacagaaauaaaatt

SEQ ID NO: 1978 - DNA, 21 bp, Artificial Sequence
  Description of Artificial Sequence: Synthetic oligonucleotide
  Description of Combined DNA/RNA Molecule: Synthetic oligonucleotide
uuuuauuucuguucuugcutt

SEQ ID NO: 1979 - DNA, 21 bp, Artificial Sequence
  Description of Artificial Sequence: Synthetic oligonucleotide
  Description of Combined DNA/RNA Molecule: Synthetic oligonucleotide
cuaguucauuucaaaauuatt

SEQ ID NO: 1980 - DNA, 21 bp, Artificial Sequence
  Description of Artificial Sequence: Synthetic oligonucleotide
  Description of Combined DNA/RNA Molecule: Synthetic oligonucleotide
uaauuuugaaaugaacuagtt

SEQ ID NO: 1981 - DNA, 21 bp, Artificial Sequence
  Description of Artificial Sequence: Synthetic oligonucleotide
  Description of Combined DNA/RNA Molecule: Synthetic oligonucleotide
caaguucacaauuacccaatt

SEQ ID NO: 1982 - DNA, 21 bp, Artificial Sequence
  Description of Artificial Sequence: Synthetic oligonucleotide
  Description of Combined DNA/RNA Molecule: Synthetic oligonucleotide
uuggguaauugugaacuugtt

SEQ ID NO: 1983 - DNA, 21 bp, Artificial Sequence
  Description of Artificial Sequence: Synthetic oligonucleotide
  Description of Combined DNA/RNA Molecule: Synthetic oligonucleotide
gcuugaagaugaaacacgatt

SEQ ID NO: 1984 - DNA, 21 bp, Artificial Sequence
  Description of Artificial Sequence: Synthetic oligonucleotide
  Description of Combined DNA/RNA Molecule: Synthetic oligonucleotide
ucguguuucaucuucaagctt

SEQ ID NO: 1985 - DNA, 21 bp, Artificial Sequence
  Description of Artificial Sequence: Synthetic oligonucleotide
  Description of Combined DNA/RNA Molecule: Synthetic oligonucleotide
agaucaagaaaauguaugatt

SEQ ID NO: 1986 - DNA, 21 bp, Artificial Sequence
  Description of Artificial Sequence: Synthetic oligonucleotide
  Description of Combined DNA/RNA Molecule: Synthetic oligonucleotide
ucauacauuuucuugaucutt

SEQ ID NO: 1987 - DNA, 21 bp, Artificial Sequence
  Description of Artificial Sequence: Synthetic oligonucleotide
  Description of Combined DNA/RNA Molecule: Synthetic oligonucleotide
ccaaagaaaacacgaauuatt

SEQ ID NO: 1988 - DNA, 21 bp, Artificial Sequence
  Description of Artificial Sequence: Synthetic oligonucleotide
  Description of Combined DNA/RNA Molecule: Synthetic oligonucleotide
uaauucguguuuucuuuggtt

SEQ ID NO: 1989 - DNA, 21 bp, Artificial Sequence
  Description of Artificial Sequence: Synthetic oligonucleotide
  Description of Combined DNA/RNA Molecule: Synthetic oligonucleotide
cuucgauaagauuauugaatt

SEQ ID NO: 1990 - DNA, 21 bp, Artificial Sequence
  Description of Artificial Sequence: Synthetic oligonucleotide
  Description of Combined DNA/RNA Molecule: Synthetic oligonucleotide
uucaauaaucuuaucgaagtt

SEQ ID NO: 1991 - DNA, 21 bp, Artificial Sequence
  Description of Artificial Sequence: Synthetic oligonucleotide
  Description of Combined DNA/RNA Molecule: Synthetic oligonucleotide
aggaacuaugaccucgacutt

SEQ ID NO: 1992 - DNA, 21 bp, Artificial Sequence
  Description of Artificial Sequence: Synthetic oligonucleotide
  Description of Combined DNA/RNA Molecule: Synthetic oligonucleotide
agucgaggucauaguuccutt

SEQ ID NO: 1993 - DNA, 21 bp, Artificial Sequence
  Description of Artificial Sequence: Synthetic oligonucleotide
  Description of Combined DNA/RNA Molecule: Synthetic oligonucleotide
acgacgagaccuucaucaatt

SEQ ID NO: 1994 - DNA, 21 bp, Artificial Sequence
  Description of Artificial Sequence: Synthetic oligonucleotide
  Description of Combined DNA/RNA Molecule: Synthetic oligonucleotide
uugaugaaggucucgucgutt

SEQ ID NO: 1995 - DNA, 21 bp, Artificial Sequence
  Description of Artificial Sequence: Synthetic oligonucleotide
  Description of Combined DNA/RNA Molecule: Synthetic oligonucleotide
aagaugaggaagaaaucgatt

SEQ ID NO: 1996 - DNA, 21 bp, Artificial Sequence
  Description of Artificial Sequence: Synthetic oligonucleotide
  Description of Combined DNA/RNA Molecule: Synthetic oligonucleotide
ucgauuucuuccucaucuutt

SEQ ID NO: 1997 - DNA, 21 bp, Artificial Sequence
  Description of Artificial Sequence: Synthetic oligonucleotide
  Description of Combined DNA/RNA Molecule: Synthetic oligonucleotide
aggaagaaaucgauguugutt

SEQ ID NO: 1998 - DNA, 21 bp, Artificial Sequence
  Description of Artificial Sequence: Synthetic oligonucleotide
  Description of Combined DNA/RNA Molecule: Synthetic oligonucleotide
acaacaucgauuucuuccutt

SEQ ID NO: 1999 - DNA, 21 bp, Artificial Sequence
  Description of Artificial Sequence: Synthetic oligonucleotide
  Description of Combined DNA/RNA Molecule: Synthetic oligonucleotide
agcuuuuuugcccugcgugtt

SEQ ID NO: 2000 - DNA, 21 bp, Artificial Sequence
  Description of Artificial Sequence: Synthetic oligonucleotide
  Description of Combined DNA/RNA Molecule: Synthetic oligonucleotide
cacgcagggcaaaaaagcutt

SEQ ID NO: 2001 - DNA, 21 bp, Artificial Sequence
  Description of Artificial Sequence: Synthetic oligonucleotide
  Description of Combined DNA/RNA Molecule: Synthetic oligonucleotide
agguaguuauccuuaaaaatt

SEQ ID NO: 2002 - DNA, 21 bp, Artificial Sequence
  Description of Artificial Sequence: Synthetic oligonucleotide
  Description of Combined DNA/RNA Molecule: Synthetic oligonucleotide
uuuuuaaggauaacuaccutt

SEQ ID NO: 2003 - DNA, 97 bp, Homo sapiens
tgctgttgacagtgagcgccagctcaaagcaatttctacatagtgaagccacagatgtatgtagaaattgctttgagctgttgcctactgcctcgga

SEQ ID NO: 2004 - DNA, 97 bp, Homo sapiens
tgctgttgacagtgagcgaaaggatgaaacacaaaaggtatagtgaagccacagatgtataccttttgtgtttcatccttctgcctactgcctcgga

SEQ ID NO: 2005 - DNA, 97 bp, Homo sapiens
tgctgttgacagtgagcgccatgtcagagttactgtttcatagtgaagccacagatgtatgaaacagtaactctgacatgatgcctactgcctcgga

SEQ ID NO: 2006 - DNA, 97 bp, Homo sapiens
tgctgttgacagtgagcgcaactagttcatttcaaaattatagtgaagccacagatgtataattttgaaatgaactagttttgcctactgcctcgga

SEQ ID NO: 2007 - DNA, 97 bp, Homo sapiens
tgctgttgacagtgagcgcacagcaagaacagaaataaaatagtgaagccacagatgtattttatttctgttcttgctgtatgcctactgcctcgga

SEQ ID NO: 2008 - DNA, 97 bp, Homo sapiens
tgctgttgacagtgagcgacaagatcaagaaaatgtatgatagtgaagccacagatgtatcatacattttcttgatcttgctgcctactgcctcgga

SEQ ID NO: 2009 - DNA, 97 bp, Homo sapiens
tgctgttgacagtgagcgcagcaagttcacaattacccaatagtgaagccacagatgtattgggtaattgtgaacttgctttgcctactgcctcgga

SEQ ID NO: 2010 - DNA, 97 bp, Homo sapiens
tgctgttgacagtgagcgccccttcgataagattattgaatagtgaagccacagatgtattcaataatcttatcgaagggatgcctactgcctcgga

SEQ ID NO: 2011 - DNA, 97 bp, Homo sapiens
tgctgttgacagtgagcgagagcttgaagatgaaacacgatagtgaagccacagatgtatcgtgtttcatcttcaagctcctgcctactgcctcgga

SEQ ID NO: 2012 - DNA, 97 bp, Homo sapiens
tgctgttgacagtgagcgacaccaaagaaaacacgaattatagtgaagccacagatgtataattcgtgttttctttggtggtgcctactgcctcgga

SEQ ID NO: 2013 - RNA, 22 nt, Artificial Sequence
  Description of Artificial Sequence: Synthetic oligonucleotide
uguagaaauugcuuugagcugu

SEQ ID NO: 2014 - RNA, 22 nt, Artificial Sequence
  Description of Artificial Sequence: Synthetic oligonucleotide
agcucaaagcaauuucuacaua

SEQ ID NO: 2015 - RNA, 22 nt, Artificial Sequence
  Description of Artificial Sequence: Synthetic oligonucleotide
uaccuuuuguguuucauccuuc

SEQ ID NO: 2016 - RNA, 22 nt, Artificial Sequence
  Description of Artificial Sequence: Synthetic oligonucleotide
aggaugaaacacaaaagguaua

SEQ ID NO: 2017 - RNA, 22 nt, Artificial Sequence
  Description of Artificial Sequence: Synthetic oligonucleotide
ugaaacaguaacucugacauga

SEQ ID NO: 2018 - RNA, 22 nt, Artificial Sequence
  Description of Artificial Sequence: Synthetic oligonucleotide
augucagaguuacuguuucaua

SEQ ID NO: 2019 - RNA, 22 nt, Artificial Sequence
  Description of Artificial Sequence: Synthetic oligonucleotide
uaauuuugaaaugaacuaguuu

SEQ ID NO: 2020 - RNA, 22 nt, Artificial Sequence
  Description of Artificial Sequence: Synthetic oligonucleotide
acuaguucauuucaaaauuaua

SEQ ID NO: 2021 - RNA, 22 nt, Artificial Sequence
  Description of Artificial Sequence: Synthetic oligonucleotide
uuuuauuucuguucuugcugua

SEQ ID NO: 2022 - RNA, 22 nt, Artificial Sequence
  Description of Artificial Sequence: Synthetic oligonucleotide
cagcaagaacagaaauaaaaua

SEQ ID NO: 2023 - RNA, 22 nt, Artificial Sequence
  Description of Artificial Sequence: Synthetic oligonucleotide
ucauacauuuucuugaucuugc

SEQ ID NO: 2024 - RNA, 22 nt, Artificial Sequence
  Description of Artificial Sequence: Synthetic oligonucleotide
aagaucaagaaaauguaugaua

SEQ ID NO: 2025 - RNA, 22 nt, Artificial Sequence
  Description of Artificial Sequence: Synthetic oligonucleotide
uuggguaauugugaacuugcuu

SEQ ID NO: 2026 - RNA, 22 nt, Artificial Sequence
  Description of Artificial Sequence: Synthetic oligonucleotide
gcaaguucacaauuacccaaua

SEQ ID NO: 2027 - RNA, 22 nt, Artificial Sequence
  Description of Artificial Sequence: Synthetic oligonucleotide
uucaauaaucuuaucgaaggga

SEQ ID NO: 2028 - RNA, 22 nt, Artificial Sequence
  Description of Artificial Sequence: Synthetic oligonucleotide
ccuucgauaagauuauugaaua

SEQ ID NO: 2029 - RNA, 22 nt, Artificial Sequence
  Description of Artificial Sequence: Synthetic oligonucleotide
ucguguuucaucuucaagcucc

SEQ ID NO: 2030 - RNA, 22 nt, Artificial Sequence
  Description of Artificial Sequence: Synthetic oligonucleotide
agcuugaagaugaaacacgaua

SEQ ID NO: 2031 - RNA, 22 nt, Artificial Sequence
  Description of Artificial Sequence: Synthetic oligonucleotide
uaauucguguuuucuuuggugg

SEQ ID NO: 2032 - RNA, 22 nt, Artificial Sequence
  Description of Artificial Sequence: Synthetic oligonucleotide
accaaagaaaacacgaauuaua

SEQ ID NO: 2033 - RNA, 21 nt, Artificial Sequence
  Description of Artificial Sequence: Synthetic oligonucleotide
ugaauuagcuguaucgucauu

SEQ ID NO: 2034 - DNA, 51 bp, Artificial Sequence
  Description of Artificial Sequence: Synthetic oligonucleotide
gtcgtatccagtgcagggtccgaggtattcgcactggatacgacaatgacg

SEQ ID NO: 2035 - DNA, 23 bp, Artificial Sequence
  Description of Artificial Sequence: Synthetic primer
ggcggctgaattagctgtatcgt

SEQ ID NO: 2036 - DNA, 15 bp, Artificial Sequence
  Description of Artificial Sequence: Synthetic primer
agtgcagggtccgag

SEQ ID NO: 2037 - DNA, 16 bp, Artificial Sequence
  Description of Artificial Sequence: Synthetic probe
tggatacgacaatgac

SEQ ID NO: 2038 - RNA, 21 nt, Artificial Sequence
  Description of Artificial Sequence: Synthetic oligonucleotide
acucgugccuuggcaaacuuu

SEQ ID NO: 2039 - DNA, 52 bp, Artificial Sequence
  Description of Artificial Sequence: Synthetic oligonucleotide
gtcgtatccagtgcagggtccgaggtattcgcactggatacgacaaagtttg

SEQ ID NO: 2040 - DNA, 21 bp, Artificial Sequence
  Description of Artificial Sequence: Synthetic primer
ggcggcactcgtgccttggca

SEQ ID NO: 2041 - DNA, 15 bp, Artificial Sequence
  Description of Artificial Sequence: Synthetic primer
agtgcagggtccgag

SEQ ID NO: 2042 - DNA, 16 bp, Artificial Sequence
  Description of Artificial Sequence: Synthetic probe
tggatacgacaaagtt

SEQ ID NO: 2043 - DNA, 21 bp, Artificial Sequence
  Description of Artificial Sequence: Synthetic primer
cgccttgacgatacagctaat

SEQ ID NO: 2044 - DNA, 23 bp, Artificial Sequence
  Description of Artificial Sequence: Synthetic primer
tgtttcctgtaggagtcctctat

SEQ ID NO: 2045 - DNA, 9 bp, Artificial Sequence
  Description of Artificial Sequence: Synthetic probe
tcactttgt

SEQ ID NO: 2046 - DNA, 22 bp, Artificial Sequence
  Description of Artificial Sequence: Synthetic primer
gtgccttgacgatacagctaat

SEQ ID NO: 2047 - DNA, 22 bp, Artificial Sequence
  Description of Artificial Sequence: Synthetic primer
ccaagagacaggtttctccatc

SEQ ID NO: 2048 - DNA, 9 bp, Artificial Sequence
  Description of Artificial Sequence: Synthetic probe
ccaacaata

SEQ ID NO: 2049 - RNA, 23 nt, Artificial Sequence
  Description of Artificial Sequence: Synthetic oligonucleotide
  modified_base (1)..(1): Inverted abasic nucleotide
  modified_base (23)..(23): Inverted abasic nucleotide
nugacgauacagcuaauucauun

SEQ ID NO: 2050 - RNA, 21 nt, Artificial Sequence
  Description of Artificial Sequence: Synthetic oligonucleotide
ugaauuagcuguaucgucauu

SEQ ID NO: 2051 - RNA, 23 nt, Artificial Sequence
  Description of Artificial Sequence: Synthetic oligonucleotide
  modified_base (1)..(1): Inverted abasic nucleotide
  modified_base (23)..(23): Inverted abasic nucleotide
naguuugccaaggcacgaguuun

SEQ ID NO: 2052 - RNA, 21 nt, Artificial Sequence
  Description of Artificial Sequence: Synthetic oligonucleotide
acucgugccuuggcaaacuuu

SEQ ID NO: 2053 - RNA, 23 nt, Artificial Sequence
  Description of Artificial Sequence: Synthetic oligonucleotide
  modified_base (1)..(1): Inverted abasic nucleotide
  modified_base (23)..(23): Inverted abasic nucleotide
ncuguuggauugauucgaaauun

SEQ ID NO: 2054 - RNA, 21 nt, Artificial Sequence
  Description of Artificial Sequence: Synthetic oligonucleotide
uuucgaaucaauccaacaguu

SEQ ID NO: 2055 - protein, 24 aa, Artificial Sequence
  Description of Artificial Sequence: Synthetic peptide
CGIFGEIEELIEEGLENLIDWGNA

SEQ ID NO: 2056 - protein, 24 aa, Artificial Sequence
  Description of Artificial Sequence: Synthetic peptide
GLFEAIEGFIENGWEGMIDGWYGC

SEQ ID NO: 2057 - protein, 27 aa, Artificial Sequence
  Description of Artificial Sequence: Synthetic peptide
GLFEAIEGFIENGWEGMIWDYGSGSCG

SEQ ID NO: 2058 - protein, 23 aa, Artificial Sequence
  Description of Artificial Sequence: Synthetic peptide
GLFEAIEGFIENGWEGMIDGWYG

SEQ ID NO: 2059 - protein, 27 aa, Artificial Sequence
  Description of Artificial Sequence: Synthetic peptide
GLFEAIEGFIENGWEGMIWDYGSGSCK

SEQ ID NO: 2060 - protein, 27 aa, Apis mellifera
CLIGAILKVLATGLPTLISWIKNKRKQ

SEQ ID NO: 2061 - protein, 26 aa, Apis mellifera
GIGAVLKVLTTGLPALISWIKRKRQQ

SEQ ID NO: 2062 - protein, 13 aa, Mesobuthus eupeus
IFGAIAGLLKNIF

SEQ ID NO: 2063 - protein, 18 aa, Mesobuthus eupeus
FFGHLFKLATKIIPSLFQ

SEQ ID NO: 2064 - protein, 21 aa, Artificial Sequence
  Description of Artificial Sequence: Synthetic peptide
KETWWETWWTEWSQPKKKRKV

SEQ ID NO: 2065 - protein, 19 aa, Artificial Sequence
  Description of Artificial Sequence: Synthetic peptide
LLIILRRRRIRKQAHAHSK

SEQ ID NO: 2066 - protein, 26 aa, Artificial Sequence
  Description of Artificial Sequence: Synthetic peptide
DPKGDPKGVTVTVTVTVTGKGDPKPD

SEQ ID NO: 2067 - protein, 17 aa, Unknown
  Description of Unknown: C105Y 1-antitrypsin peptide
CSIPPEVKFNKPFVYLI

SEQ ID NO: 2068 - protein, 27 aa, Unknown
  Description of Unknown: Transportan galanin and mastoparan peptide
GWTLNSAGYLLGKINLKALAALAKKIL

SEQ ID NO: 2069 - protein, 21 aa, Unknown
  Description of Unknown: TP10 Galanin and mastoparan peptide
AGYLLGKINLKALAALAKKIL

SEQ ID NO: 2070 - protein, 17 aa, Artificial Sequence
  Description of Artificial Sequence: Synthetic peptide
GALFLGFLGAAGSTMGA

SEQ ID NO: 2071 - protein, 20 aa, Herpes simplex virus 1
HGLASTLTRWAHYNALIRAF

SEQ ID NO: 2072 - protein, 20 aa, Unknown
  Description of Unknown: CADY PPTG1 peptide
GLWRALWRLLRSLWRLLWRA

SEQ ID NO: 2073 - protein, 30 aa, Artificial Sequence
  Description of Artificial Sequence: Synthetic polypeptide
WEAALAEALAEALAEHLAEALAEALEALAA

SEQ ID NO: 2074 - protein, 24 aa, Artificial Sequence
  Description of Artificial Sequence: Synthetic peptide
GLFEAIEGFIENGWEGMIDGWYGC

SEQ ID NO: 2075 - protein, 23 aa, Artificial Sequence
  Description of Artificial Sequence: Synthetic peptide
GLFGAIAGFIENGWEGMIDGWYG

SEQ ID NO: 2076 - protein, 36 aa, Artificial Sequence
  Description of Artificial Sequence: Synthetic polypeptide
GLFGAIAGFIENGWEGMIDGRQIKIWFQNRRMKWKK

SEQ ID NO: 2077 - protein, 26 aa, Artificial Sequence
  Description of Artificial Sequence: Synthetic peptide
GLFGAIAGFIENGWEGMIDGSSKKKK

SEQ ID NO: 2078 - protein, 24 aa, Artificial Sequence
  Description of Artificial Sequence: Synthetic peptide
GLFEAIAGFIENGWEGMIDGGGYC

SEQ ID NO: 2079 - protein, 23 aa, Artificial Sequence
  Description of Artificial Sequence: Synthetic peptide
GLFHAIAHFIHGGWHGLIHGWYG

SEQ ID NO: 2080 - protein, 30 aa, Artificial Sequence
  Description of Artificial Sequence: Synthetic polypeptide
GLFEAIEGFIENGWEGLAEALAEALEALAA

SEQ ID NO: 2081 - protein, 29 aa, Artificial Sequence
  Description of Artificial Sequence: Synthetic peptide
KWKLFKKIGAVLKVLTTGYGRKKRRQRRR

SEQ ID NO: 2082 - RNA, 21 nt, Artificial Sequence
  Description of Artificial Sequence: Synthetic oligonucleotide
acucgugccuuggcaaacuuu

SEQ ID NO: 2083 - RNA, 21 nt, Artificial Sequence
  Description of Artificial Sequence: Synthetic oligonucleotide
aguuugccaaggcacgaguuu

SEQ ID NO: 2084 - RNA, 21 nt, Artificial Sequence
  Description of Artificial Sequence: Synthetic oligonucleotide
acucgugccuuggcaaacuuu

SEQ ID NO: 2085 - RNA, 21 nt, Artificial Sequence
  Description of Artificial Sequence: Synthetic oligonucleotide
aguuugccaaggcacgaguuu

SEQ ID NO: 2086 - RNA, 21 nt, Artificial Sequence
  Description of Artificial Sequence: Synthetic oligonucleotide
acucgugccuuggcaaacuuu

SEQ ID NO: 2087 - RNA, 21 nt, Artificial Sequence
  Description of Artificial Sequence: Synthetic oligonucleotide
aguuugccaaggcacgaguuu

SEQ ID NO: 2088 - RNA, 21 nt, Artificial Sequence
  Description of Artificial Sequence: Synthetic oligonucleotide
ugaauuagcuguaucgucauu

SEQ ID NO: 2089 - DNA, 21 bp, Artificial Sequence
  Description of Artificial Sequence: Synthetic oligonucleotide
  Description of Combined DNA/RNA Molecule: Synthetic oligonucleotide
tgacgauacagcuaauucauu

SEQ ID NO: 2090 - RNA, 21 nt, Artificial Sequence
  Description of Artificial Sequence: Synthetic oligonucleotide
ugaauuagcuguaucgucauu

SEQ ID NO: 2091 - RNA, 21 nt, Artificial Sequence
  Description of Artificial Sequence: Synthetic oligonucleotide
ugacgauacagcuaauucauu

SEQ ID NO: 2092 - RNA, 21 nt, Artificial Sequence
  Description of Artificial Sequence: Synthetic oligonucleotide
ugaauuagcuguaucgucauu

SEQ ID NO: 2093 - RNA, 21 nt, Artificial Sequence
  Description of Artificial Sequence: Synthetic oligonucleotide
ugacgauacagcuaauucauu

SEQ ID NO: 2094 - RNA, 21 nt, Artificial Sequence
  Description of Artificial Sequence: Synthetic oligonucleotide
uaaguauagguccucauuauu

SEQ ID NO: 2095 - RNA, 21 nt, Artificial Sequence
  Description of Artificial Sequence: Synthetic oligonucleotide
uaaugaggaccuauacuuauu

SEQ ID NO: 2096 - DNA, 21 bp, Artificial Sequence
  Description of Artificial Sequence: Synthetic oligonucleotide
  Description of Combined DNA/RNA Molecule: Synthetic oligonucleotide
tuucgaaucaauccaacaguu

SEQ ID NO: 2097 - RNA, 21 nt, Artificial Sequence
  Description of Artificial Sequence: Synthetic oligonucleotide
cuguuggauugauucgaaauu

SEQ ID NO: 2098 - RNA, 21 nt, Artificial Sequence
  Description of Artificial Sequence: Synthetic oligonucleotide
uuucgaaucaauccaacaguu

SEQ ID NO: 2099 - RNA, 21 nt, Artificial Sequence
  Description of Artificial Sequence: Synthetic oligonucleotide
cuguuggauugauucgaaauu

SEQ ID NO: 2100 - RNA, 21 nt, Artificial Sequence
  Description of Artificial Sequence: Synthetic oligonucleotide
uuucgaaucaauccaacaguu

SEQ ID NO: 2101 - RNA, 21 nt, Artificial Sequence
  Description of Artificial Sequence: Synthetic oligonucleotide
cuguuggauugauucgaaauu

SEQ ID NO: 2102 - RNA, 21 nt, Artificial Sequence
  Description of Artificial Sequence: Synthetic oligonucleotide
auaaaaucuacagucauaguu

SEQ ID NO: 2103 - RNA, 21 nt, Artificial Sequence
  Description of Artificial Sequence: Synthetic oligonucleotide
cuaugacuguagauuuuauuu

SEQ ID NO: 2104 - RNA, 21 nt, Artificial Sequence
  Description of Artificial Sequence: Synthetic oligonucleotide
uuaaaaucuacagucauaguu

SEQ ID NO: 2105 - RNA, 21 nt, Artificial Sequence
  Description of Artificial Sequence: Synthetic oligonucleotide
cuaugacuguagauuuuaauu

SEQ ID NO: 2106 - RNA, 21 nt, Artificial Sequence
  Description of Artificial Sequence: Synthetic oligonucleotide
uuaaaaucuacagucauaguu

SEQ ID NO: 2107 - RNA, 21 nt, Artificial Sequence
  Description of Artificial Sequence: Synthetic oligonucleotide
cuaugacuguagauuuuaauu

SEQ ID NO: 2108 - RNA, 21 nt, Artificial Sequence
  Description of Artificial Sequence: Synthetic oligonucleotide
gagagcuccauagugacacuu

SEQ ID NO: 2109 - RNA, 21 nt, Artificial Sequence
  Description of Artificial Sequence: Synthetic oligonucleotide
gugucacuauggagcucucuu

SEQ ID NO: 2110 - protein, 4 aa, Artificial Sequence
  Description of Artificial Sequence: Synthetic peptide
EAFQ

SEQ ID NO: 2111 - protein, 4 aa, Artificial Sequence
  Description of Artificial Sequence: Synthetic peptide
GGFG

SEQ ID NO: 2112 - protein, 4 aa, Artificial Sequence
  Description of Artificial Sequence: Synthetic peptide
ALAL

SEQ ID NO: 2113 - protein, 4 aa, Artificial Sequence
  Description of Artificial Sequence: Synthetic peptide
GFLG

SEQ ID NO: 2114 - DNA, 19 bp, Artificial Sequence
  Description of Artificial Sequence: Synthetic probe
ggatgagtatgaccctacg

SEQ ID NO: 2115 - DNA, 20 bp, Artificial Sequence
  Description of Artificial Sequence: Synthetic probe
gaggattcctacaggaagca

SEQ ID NO: 2116 - RNA, 21 nt, Artificial Sequence
  Description of Artificial Sequence: Synthetic oligonucleotide
uaucgacguguccagcuaguu

SEQ ID NO: 2117 - DNA, 21 bp, Artificial Sequence
  Description of Artificial Sequence: Synthetic oligonucleotide
  Description of Combined DNA/RNA Molecule: Synthetic oligonucleotide
tcucgugccuuggcaaacuuu

What is claimed is:

1. A method for treating cancer by administering a composition to a subject in need thereof, wherein the composition comprises:
   an anti-transferrin receptor antibody or its binding fragments thereof;
   a double-stranded siRNA molecule consisting of a passenger strand and a guide strand; and
   a polymer conjugated to the 3' terminus of the passenger strand;
wherein said double-stranded siRNA molecule is conjugated to a cysteine of said antibody by a linker;
wherein said double-stranded siRNA molecule comprises at least one 2' modified nucleotide, at least one modified internucleotide linkage, or at least one inverted abasic moiety; and
wherein the linker is conjugated to the 5' terminus of the passenger strand of said double stranded siRNA molecule.

2. The method of claim 1, wherein the cancer is a solid tumor.

3. The method of claim 1, wherein the cancer is a hematologic malignancy.

4. The method of claim 1, wherein the cancer comprises bladder cancer, breast cancer, colorectal cancer, endometrial cancer, esophageal cancer, glioblastoma multiforme, head and neck cancer, kidney cancer, lung cancer, ovarian cancer, pancreatic cancer, prostate cancer, or thyroid cancer.

5. The method of claim 1, wherein the cancer is breast cancer, lung cancer, ovarian cancer, prostate cancer, or skin cancer.

6. The method of claim 1, wherein the cancer comprises acute myeloid leukemia, CLL, DLBCL, or multiple myeloma.

7. The method of claim 1, wherein the linker is a cleavable linker.

8. The method of claim 1, wherein the linker is a non-cleavable linker.

9. The method of claim 1, wherein the polymer is polyethylene glycol (PEG).

10. The method of claim 9, wherein the PEG has a molecular weight from about 1000 Da to about 5000 Da.

11. The method of claim 9, wherein the PEG has a molecular weight of about 1000 Da, 2000 Da, or 5000 Da.

12. The method of claim 1, wherein the antibody or binding fragment thereof comprises a humanized antibody or binding fragment thereof, chimeric antibody or binding fragment thereof, monoclonal antibody or binding fragment thereof, monovalent Fab', divalent Fab2 or single-chain variable fragment (scFv).

13. The method of claim 1, wherein the at least one 2' modified nucleotide comprises 2'-O-methyl, 2'-O-methoxyethyl (2'-O-MOE), 2'-O-aminopropyl, 2'-deoxy, 2'-fluoro, 2'-O-aminopropyl (2'-O-AP), 2'-O-dimethylaminoethyl (2'-O-DMAOE), 2'-O-dimethylaminopropyl (2'-O-DMAP), 2'-O-dimethylaminoethyloxyethyl (2'-O-DMAEOE), or 2'-O—N-methylacetamido (2'-O-NMA) modified nucleotide.

14. The method of claim 1, wherein the at least one 2' modified nucleotide comprises locked nucleic acid (LNA) or ethylene nucleic acid (ENA).

15. The method of claim 1, wherein the at least one modified internucleotide linkage comprises a phosphorothioate linkage or a phosphorodithioate linkage.

16. The method of claim 1, wherein the at least one inverted abasic moiety is at least one terminus.

17. The method of claim 1, wherein the guide strand hybridizes to a target region of a gene selected from the group consisting of KRAS, EGFR, AR, CTNNB1, PIK3CA, PIK3CB, MYC, and HPRT1.

18. The method of claim 1, wherein the guide strand comprises a sequence selected from SEQ ID NOs: 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 453, 455, 457, 459, 461, 463, 465, 467, 469, 471, 473, 475, 477, 479, 481, 483, 485, 487, 489, 491, 493, 495, 497, 499, 501, 503, 505, 507, 509, 511, 513, 515, 517, 519, 521, 523, 525, 527, 529, 531, 533, 535, 537, 539, 541, 543, 545, 547, 549, 551, 553, 555, 557, 559, 561, 563, 565, 567, 569, 571, 573, 575, 577, 579, 581, 583, 585, 587, 589, 591, 593, 595, 597, 599, 601, 603, 605, 607, 609, 611, 613, 615, 617, 619, 621, 623, 625, 627, 629, 631, 633, 635, 637, 639, 641, 643, 645, 647, 649, 651, 653, 655, 657, 659, 661, 663, 665, 667, 669, 671, 673, 675, 677, 679, 681, 683, 685, 687, 689, 691, 693, 695, 697, 699, 701, 703, 705, 707, 709, 711, 713, 715, 717, 719, 721, 723, 725, 727, 729, 731, 733, 735, 737, 739, 741, 743, 745, 747, 749, 751, 753, 755, 757, 759, 761, 763, 765, 767, 769, 771, 773, 775, 777, 779, 781, 783, 785, 787, 789, 791, 793, 795, 797, 799, 801, 803, 805, 807, 809, 811, 813, 815, 817, 819, 821, 823, 825, 827, 829, 831, 833, 835, 837, 839, 841, 843, 845, 847, 849, 851, 853, 855, 857, 859, 861, 863, 865, 867, 869, 871, 873, 875, 877, 879, 881, 883, 885, 887, 889, 891, 893, 895, 897, 899, 901, 903, 905, 907, 909, 911, 913, 915, 917, 919, 921, 923, 925, 927, 929, 931, 933, 935, 937, 939, 941, 943, 945, 947, 949, 951, 953, 955, 957, 959, 961, 963, 965, 967, 969, 971, 973, 975, 977, 979, 981, 983, 985, 987, 989, 991, 993, 995, 997, 999, 1001, 1003, 1005, 1007, 1009, 1011, 1013, 1015, 1017, 1019, 1021, 1023, 1025, 1027, 1029, 1031, 1033, 1035, 1037, 1039, 1041, 1043, 1045, 1047, 1049, 1051, 1053, 1055, 1057, 1059, 1061, 1063, 1065, 1067, 1069, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1115, 1117, 1119, 1121, 1123, 1125, 1127, 1129, 1131, 1133, 1135, 1137, 1139, 1141, 1143, 1145, 1147, 1149, 1151, 1153, 1155, 1157, 1159, 1161, 1163, 1165, 1167, 1169, 1171, 1173, 1175, 1177, 1179, 1181, 1183, 1185, 1187, 1189, 1191, 1193, 1195, 1197, 1199, 1201, 1203, 1205, 1207, 1209, 1211, 1213, 1215, 1217, 1219, 1221, 1223, 1225, 1227, 1229, 1231, 1233, 1235, 1237, 1239, 1241, 1243, 1245, 1247, 1249, 1251, 1253, 1255, 1257, 1259, 1261, 1263, 1265, 1267, 1269, 1271, 1273, 1275, 1277, 1279, 1281, 1283, 1285, 1287, 1289, 1291, 1293, 1295, 1297, 1299, 1301, 1303, 1305, 1307, 1309, 1311, 1313, 1315, 1317, 1319, 1321, 1323, 1325, 1327, 1329, 1331, 1333, 1335, 1337, 1339, 1341, 1343, 1345, 1347, 1349, 1351, 1353, 1355, 1357, 1359, 1361, 1363, 1365, 1367, 1369, 1371, 1373, 1375, 1377, 1379, 1381, 1383, 1385, 1387, 1389, 1391, 1393, 1395, 1397, 1399, 1401, 1403, 1405, 1407, 1409, 1411, 1413, 1415, 1417, 1419, 1421, 1423, 1425, 1427, 1429, 1431, 1433, 1435, 1437, 1439, 1441, 1443, 1445, 1447, 1449, 1451, 1453, 1455, 1457, 1459, 1461, 1463, 1465, 1467, 1469, 1471, 1473, 1475, 1477, 1479, 1481, 1483, 1485, 1487, 1489, 1491, 1493, 1495, 1497, 1499, 1501, 1503, 1505, 1507, 1509, 1511, 1513, 1515, 1517, 1519, 1521, 1523, 1525, 1527, 1529, 1531, 1533, 1535, 1537, 1539, 1541, 1543, 1545, 1547, 1549, 1551, 1553, 1555, 1557, 1559, 1561, 1563, 1565, 1567, 1569, 1571, 1573, 1575, 1577, 1579, 1581, 1583, 1585, 1587, 1589, 1591, 1593, 1595, 1597, 1599, 1601, 1603, 1605, 1607, 1609, 1611, 1613, 1615, 1617, 1619, 1621, 1623, 1625, 1627, 1629, 1631, 1633, 1635, 1637, 1639, 1641, 1643, 1645, 1647, 1649, 1651, 1653, 1655, 1657, 1659, 1661, 1663, 1665, 1667, 1669, 1671, 1673, 1675, 1677, 1679, 1681, 1683, 1685, 1687, 1689, 1691, 1693, 1695, 1697, 1699, 1701, 1703, 1705, 1707, 1709, 1711, 1713, 1715, 1717, 1719, 1721, 1723, 1725, 1727, 1729, 1731, 1733, 1735, 1737, 1739, 1741, 1743, 1745, 1747, 1749, 1751, 1753, 1755, 1757, 1759, 1761, 1763, 1765, 1767, 1769, 1771, 1773, 1775, 1777, 1779, 1781, 1783, 1785, 1787, 1789, 1791, 1793, 1795, 1797, 1799, 1801, 1803, 1805, 1807, 1809, 1811, 1813, 1815, 1817, 1819, 1821, 1823, 1825, 1827, 1829, 1831, 1833, 1835, 1837, 1839, 1841, 1843, 1845, 1847, 1849, 1851, 1853, 1855, 1857, 1859, 1861, 1863, 1865, 1867, 1869, 1871, 1873, 1875, 1877, 1879, 1881, 1883, 1885, 1887, 1889, 1891, 1893, 1895, 1897, 1899, 1901, 1903, 1905, 1907, 1909, 1911, 1913, 1915, 1917, 1919, 1921, 1923, 1925, 1927, 1929, 1931, 1933, 1935, 1937, 1939, 1941, 1943, 1945, 1947, 1949, 1951, 1953, 1955, 1968, 1970, 1972, 1974, 1976, 1978, 1980, 1982, 1984, 1986, 1988, 1990, 1992, 1994, 1996, 1998, 2000, 2002, 2013, 2015, 2017, 2019, 2021, 2023, 2025, 2027, 2029, 2031, 2082, 2084, 2086, 2088, 2090, 2092, 2094, 2096, 2098, 2100, 2102, 2104, 2106, and 2108.

\* \* \* \* \*